US007495147B2

(12) United States Patent
Stefansson et al.

(10) Patent No.: US 7,495,147 B2
(45) Date of Patent: Feb. 24, 2009

(54) NEUREGULIN-1 TRANSGENIC MOUSE AND METHODS OF USE

(75) Inventors: Hreinn Stefansson, Gardabaer (IS); Valgerdur Steinthorsdottir, Reykjavik (IS); Jeffrey R. Gulcher, Chicago, IL (US); Mark Gurney, E. Grand Rapids, MI (US); Thorkell Andresson, Reykjavik (IS)

(73) Assignee: deCODE genetics ehf., Reykjavik (IS)

( * ) Notice: Subject to any disclaimer, the term of this patent is extended or adjusted under 35 U.S.C. 154(b) by 1262 days.

(21) Appl. No.: 10/107,604

(22) Filed: Mar. 26, 2002

(65) Prior Publication Data

US 2008/0263690 A1 Oct. 23, 2008

Related U.S. Application Data

(63) Continuation-in-part of application No. 09/946,807, filed on Sep. 5, 2001, now abandoned, which is a continuation-in-part of application No. PCT/US01/06377, filed on Feb. 28, 2001, and a continuation-in-part of application No. 09/795,668, filed on Feb. 28, 2001, now abandoned, which is a continuation-in-part of application No. 09/515,716, filed on Feb. 28, 2000, now abandoned.

(51) Int. Cl.
*G01N 33/00* (2006.01)
*A01K 67/00* (2006.01)
*A01K 67/027* (2006.01)

(52) U.S. Cl. .................................. 800/3; 800/9; 800/18

(58) Field of Classification Search .................. 424/9.2; 800/3, 18, 9
See application file for complete search history.

(56) References Cited

U.S. PATENT DOCUMENTS 6,218,595 B1 4/2001 Giros et al.
6,387,638 B1 5/2002 Ballinger et al.

FOREIGN PATENT DOCUMENTS

| WO | WO 94/26298 | 11/1994 |
|----|-------------|---------|
| WO | WO 98/42362 | 10/1998 |
| WO | WO 99/62955 | 12/1999 |
| WO | WO 01/64876 | 9/2001 |
| WO | WO 01/64877 A2 | 9/2001 |

OTHER PUBLICATIONS

Gerlai R. Gene targeting studies of mammalian behavior: is it the mutation or the background genotype? (1996) 19: 177-181.*
Lariviere WR. Transgenic studies of pain and analgesia: Mutation or background genotype? (2001) 297: 467-473.*
Petryshen TL, Support for involvment for neuregulin 1 in schizophrenia pathophysiology, 2005, Mol. Psychiatry, vol. 10, pp. 366-374.*
Stefannson H, Neuregulin 1 and susceptibility to schizophrenia, 2002, Am. J. Hum. Genet., vol. 71, pp. 877-892.*
Sandrock et al. Maintenance of Acetylcholine Receptor Number by Neuregulins at the Neuromuscular Junction in Vivo, 1995, Science, vol. 276, pp. 599-603.*
Crawley JN, Behavioral phenotyping of transgenicand knockout mice: experimental design and evaluation of general health, sensory functions, motor abilities, and specific behavioral tests, 1999, Brain Research, vol. 835, pp. 18-26.*
1997, Montkowski et al., Brain Res., vol. 762, pp. 12-18.*
1998, Picciotto et al., Physiological Rev., vol. 78, pp. 1131-1163.*
1999, Crabbe et al., Science, vol. 284, pp. 1670-1672.*
2004, Zimmer et al., Psychopharmacology, vol. 176, pp. 343-352.*
Britsch, S., et al. "The ErbB2 and ErbB3 Receptors and their Ligand, Neuregulin-1, are Essential for Development of the Sympathetic Nervous System," *Genes & Development*, 12:1825-1836 (1998).
Crovello, C.S., et al., "Differential Signaling by the Epidermal Growth Factor-Like Growth Factors Neuregulin-1 and Neuregulin-2," *Journal of Biological Chemistry*, 273:26954-26961 (1998).
Elenius, K., et al., "A Novel Juxtamembrane Domain Isoform of HER4/ErbB4," *Journal of Biological Chemistry*, 272:26761-26768 (1997).
Fitzpatrick, V.D., et al., "Formation of a High Affinity Heregulin Binding Site Using the Soluble Extracellular Domains of ErbB2 with ErbB3 or ErbB4," *FEBS Letters*, 431:102-106 (1998).
Higashiyama, S., et al, "A Novel Brain-Derived Member of the Epidermal Growth Factor Family that Interacts with ErbB3 and ErbB4," *Journal of Biological Chemistry*, 122:675-680 (1997).
Le, X.F., et al., "Anti-HER2 Antibody and Heregulin Suppress Growth of HER2-Overexpressing Human Breast Cancer Cells Through Difference Mechanisms," *Clinical Cancer Research*, 6:260-270 (2000).
Rosen, M., "Downregulation and Increased Turnover of β-Amyloid Precursor Protein in Skeletal Muscle Cultures by Neuregulin-1," *Experimental Neurology*, 181:170-180 (2003).

(Continued)

*Primary Examiner*—Deborah Crouch
*Assistant Examiner*—David A. Montanari
(74) *Attorney, Agent, or Firm*—Hamilton, Brook, Smith & Reynolds, P.C.

(57) ABSTRACT

Nucleic acids comprising the neuregulin 1 gene (NRG1) and encoding NRG1 polypeptides are disclosed. Also described are related nucleic acids encoding NRG1 polypeptides; NRG1 polypeptides; antibodies that bind to NRG1 polypeptides; methods of diagnosis of susceptibility to schizophrenia; assays for agents that alter the activity of NRG1 polypeptide or which identify NRG1 binding agents, and the gents or binding agents identified by the assays; NRG1 therapeutic agents, including the NRG1 nucleic acids, NRG1 polypeptides, or agents that alter the activity of an NRG1 polypeptides; pharmaceutical compositions comprising the NRG1 therapeutic agents; as well as methods of therapy of schizophrenia. Novel haplotypes with a common core haplotype in affected individuals are described, as well as their use in methods for screening for susceptibility to schizophrenia. Also described are hypomorphic mice for use in identifying phenotypes associated with schizophrenia, as well as for use in assessing agents of interest for neuroleptic activity and for potential therapeutic use for treatment of schizophrenia.

2 Claims, 18 Drawing Sheets

OTHER PUBLICATIONS

Stefansson, H., et al., "Association of Neuregulin 1 with Schizophrenia Confirmed in a Scottish Population," *Am. J. Human Genet.*, 72:83-87 (2003).

Straub, et al., "Genome-Wide Scans of Three Independent Sets of 90 Irish Multiplex Schizophrenia Families and Follow-Up Selected Regions in All Families Provides Evidence for Multiple Susceptibility Genes," *Molecular Psychiatry*, 7:542-559 (2002).

Tang, C.K, et al., "Ribozyme-Mediated Down-Regulation of ErbB-4 in Estrogen Receptor-Positive Breast Cancer Cells Inhibits Proliferation Both in Vitro and in Vivo," *Cancer Research*, 59:5315-5322 (1999).

Williams, N.M., et al., "Support for Genetic Variation in Neuregulin 1 and Susceptibility to Schizophrenia," *Molecular Psychiatry*, 8:485-487 (2003).

Yang, J.Z., et al., "Association Study of Neuregulin 1 Gene with Schizophrenia," *Molecular Psychiatry*, 8:706-709 (2003).

Yoo, J-Y, et al., "Interaction of the PA2G4 (EPB1) Protein with ErbB-3 and Regulation of this Binding by Heregulin," *British Journal of Cancer*, 82:683-690 (2000).

Zhao, J.J. and Lemke, G., "Selective Disruption of Neuregulin-1 Function in Vertebrate Embryos Using Ribozyme-tRNA Transgenes," *Development*, 125:1899-1907 (1998).

Mohn, A.R., et al., "Mice with Reduced NMDA Receptor Expression Display Behaviors Related to Schizophrenia," *Cell*, 98: 427-436 (1999).

Rieff, H.I, et al., "Neuregulin Induces $GABA_A$ Receptor Subunit Expression and Neurite Outgrowth in Cerebellar Granule Cells," *J. Neurosci. 19*: 10757-10766 (1999).

Martin, P., et al., "Rodent Data and General Hypothesis: Antipsychotic Action Exerted Through 5-HT2A Receptor Antagonism is Dependent on Increased Serotonergic Tone," *J. Neural Transm..* 105: 365-396 (1998).

Swerdlow, N.R. and Geyer, M.A., "Using an Animal Model of Deficient Sensorimotor Gating to Study the Pathophysiology and New Treatments of Schizophrenia," *Schizophrenia Bulletin*, 24: 285-301 (1998).

Dulawa, S.C. and Geyer, M.A., "Psychopharmacology of Prepulse Inhibition in Mice," *Chin. J. Physiol.*, 39: 139-146 (1996).

Harrison, P.J., et al., "Schizophrenia Genes, Gene Expression, and Neurophathology: On the Matter of Their Convergence," *Molecular Psychiatry* 10: 40-68 (2005).

Talmage, D.A. and L.W. Role, "Multiple Personalities of Neuregulin Gene Family Members," *Journal of Comparative Neurology*, 472: 134-139 (2004).

Harrison, P.J. and Weinberger, D.R., "Schizophrenia Genes, Gene Expression, and Neuropathology: On the Matter of Their Convergence," *Molecular Psychiatry*, 10: 40-68 (2005).

Jeschke, M., et al., "Targeted Inhibition of Tumor-Cell Growth by Recombinant Heregulin-Toxin Fusion Proteins," *International Journal of Cancer*, 60:730-739 (1995).

Tang, C.K., et al., "ErbB-4 Ribozymes Abolish Neuregulin-Induced Mitogenesis," *Cancer Research*, 58:3415-3422 (1998).

Azemar, M., et al., "Recombinant Antibody Toxins Specific for ErbB2 and EGF Receptor Inhibit the In Vitro Grown of Human Head and Neck Cancers and Cause Rapid Tumor Regression In Vivo," *International Journal of Cancer*, 86:269-275 (2000).

Buonanno, A., et al., "Neuregulin and ErbB Receptor Signaling Pathways in the Nervous System," *Curr. Opinion in Neurobiology*, 11:287-296 (2001).

* cited by examiner

| | H166-2 | H166-5 | D8S339 | 486I6-110P15 | 486I6-111M6 | D8S1770 | D8S1769 | 29H12-7320 | D8S1711 | 29H12-121L21 | 450K14-72458 | 478B14-642 | 487-2 |
|---|---|---|---|---|---|---|---|---|---|---|---|---|---|
| 1 | . . | -10 A | . . | . . | . . | 10 A | . . | 6 A | 0 A | 8 A | 0 A | 2 A | 16 |
| 2 | . . | -10 * | . . | . . | . . | 10 . | . . | 6 . | 0 A | 8 A | 0 * | 2 . | 16 |
| 3 | 0 A | -10 A | . . | 4 A | -2 A | 8 A | 0 A | 6 A | -2 A | 8 A | 0 A | 2 A | 16 |
| 4 | 0 A | -10 A | . . | 0 A | -2 A | 10 A | 0 A | 6 A | 0 A | 8 A | 0 A | 2 A | 16 |
| 5 | 0 . | -10 . | . . | 0 . | -2 . | 10 . | 0 . | 6 A | 0 . | . . | 0 . | . . | . |
| 6 | 0 . | -10 . | . . | 0 . | -2 . | 10 . | 0 . | 6 . | -2 T | 8 . | 0 . | 2 . | 16 |
| 7 | 0 . | -12 . | . . | -8 . | 0 D | 10 . | 0 . | 6 . | 0 . | 8 . | 0 . | . . | . |
| 8 | 0 A | 6 A | . . | 0 A | 0 A | 10 A | 6 A | 8 A | 0 A | 0 A | 4 A | . . | . |
| 9 | . . | -4 A | . . | . . | . . | 10 A | . . | 6 A | 0 A | 0 A | . . | 2 A | 16 |
| 10 | 0 . | 0 . | . . | . . | -6 . | 10 . | . . | 6 . | 0 . | 8 . | . . | 12 A | 16 |
| 11 | 0 . | -12 . | . . | . . | -6 . | 10 . | 0 . | 6 . | 0 . | 0 D | 0 A | 2 . | 16 |
| 12 | 0 A | 4 A | . . | . . | 0 A | 10 A | . . | 6 A | 0 A | 8 A | 0 A | 2 A | 16 |
| 13 | 0 . | 4 . | . . | 4 . | 0 . | 10 . | . . | 6 A | 0 . | 8 . | 0 . | 2 . | 16 |
| 14 | . . | 4 A | . . | . . | . . | 10 A | . . | 6 A | 0 A | 8 A | 0 A | 2 A | 16 |
| 15 | . . | . . | . . | . . | . . | 10 . | 0 . | 6 . | 0 . | 8 . | 0 A | 2 . | 16 |
| 16 | . . | . . | . . | . . | . . | 10 . | 0 . | 6 . | 0 . | 8 . | 0 A | 2 . | 16 |
| 17 | 0 . | 4 . | . . | 0 . | 0 . | 10 . | 0 . | 6 . | 0 . | 8 D | . . | 2 . | 16 |
| 18 | 0 . | 0 . | . . | . . | -6 A | 10 . | 0 . | 6 . | 0 . | 8 . | 0 A | 2 . | 16 |
| 19 | 0 A | 2 A | 10 A | 0 A | -2 A | 10 A | 0 A | 6 A | 0 A | 8 A | 0 A | 2 A | 16 |
| 20 | 0 A | -6 A | . . | 0 A | 0 A | 10 A | 0 A | 6 A | 0 A | 8 A | 4 A | 4 A | 16 |
| 21 | 0 . | 0 . | . . | 0 . | 0 . | 10 T | 0 A | 6 . | 0 . | 8 . | 0 . | 2 . | 16 |
| 22 | 0 . | 0 . | . . | . . | . . | 10 . | 0 . | 6 . | 0 . | 8 . | 0 A | 2 . | 16 |
| 23 | 0 A | 0 A | . . | 0 A | -4 A | 10 A | . . | 6 A | 0 . | 8 A | 0 A | 4 A | 16 |
| 24 | 0 A | 0 A | 12 A | 4 A | -8 A | 10 A | 0 A | 6 A | 0 A | 8 A | 0 A | 12 A | 16 |
| 25 | 0 U | -4 U | . . | 0 U | . . | 10 U | . . | 6 U | 0 U | 8 U | 4 U | 16 U | 16 |
| 26 | 0 A | 4 A | . . | 4 A | . . | 10 A | 8 A | 6 A | 0 A | 8 A | . . | 2 A | 16 |
| 27 | . . | . . | . . | . . | . . | 10 . | 0 . | 6 . | 0 . | 0 D | 0 A | 2 . | 16 |
| 28 | 0 A | 2 A | 0 A | 0 A | 0 A | 0 A | 8 A | 6 A | 0 A | 8 A | 0 A | 2 A | 16 |
| 29 | 0 . | 4 . | . . | 0 . | 0 . | 10 . | 0 . | 6 . | 0 . | . . | 0 A | 2 . | 16 |
| 30 | 0 U | 8 U | . . | -4 U | 0 U | 12 U | . . | 6 U | . . | 8 U | 4 U | 4 U | . |
| 31 | . . | . . | . . | . . | . . | . . | . . | 6 A | 0 A | . . | 0 A | 2 A | . |
| 32 | 0 . | . . | . . | 4 A | -6 A | 12 D | 0 D | 6 D | 0 D | 8 D | . . | . . | . |
| 33 | 0 U | 8 U | . . | 4 U | -2 U | . . | 4 U | 6 U | 0 U | 8 U | 2 U | . . | . |
| 34 | 0 U | 6 U | 14 U | 0 U | 0 U | 10 U | 10 U | 6 U | 0 U | 8 U | . . | . . | . |
| 35 | 0 A | . . | . . | . . | -2 A | 10 . | -2 A | 6 . | 0 . | 8 D | 0 . | . . | . |
| 36 | 0 . | 0 . | . . | . . | 0 . | 0 . | 4 . | 10 . | 0 . | . . | 0 . | 2 . | 16 |
| 37 | 0 A | 2 A | . . | 0 A | -2 A | 10 A | 2 A | 4 A | 0 A | 8 A | 0 A | 8 A | 16 |
| 38 | 0 A | 2 A | . . | 0 A | -2 A | 10 A | 2 A | 4 A | 0 A | 8 A | 0 A | 8 A | 16 |
| 39 | 0 A | 2 A | . . | 0 A | -2 A | 10 A | 2 A | 4 A | 0 A | 8 A | 0 A | 8 A | 16 |
| 40 | 0 A | 2 A | . . | 0 A | -2 A | 10 A | 2 A | . . | 0 A | 8 A | . . | . . | . |
| 41 | 0 . | . . | . . | . . | . . | 0 . | 10 . | 2 . | -4 . | -2 . | 0 . | 4 . | 16 |
| 42 | 0 . | -4 A | . . | . . | . . | 0 . | 10 . | -4 . | -2 . | 0 A | 4 . | 4 . | 16 |
| 43 | 0 U | 0 U | . . | 0 U | 0 U | 12 U | 2 U | . . | 0 U | 0 U | . . | 4 U | 16 |
| 44 | . . | -12 . | . . | . . | . . | 10 . | . . | 4 . | -2 . | 8 . | -2 . | 8 . | 16 |
| 45 | 0 U | 4 U | . . | 4 U | -2 U | 10 U | . . | -4 U | 0 U | 0 U | 0 U | 4 U | 16 |
| 46 | 0 . | 0 . | . . | 0 . | 0 . | 0 . | 4 . | 10 . | 0 . | 0 . | . . | 2 A | 16 |
| 47 | 0 A | 2 A | . . | 8 A | 0 A | 10 A | . . | 0 A | 0 A | 4 A | -6 A | 14 A | 16 |
| 48 | 0 U | 0 U | . . | 4 U | 0 U | 10 U | 0 U | 6 U | 0 U | 8 U | . . | 14 U | 16 |
| 49 | 0 A | 4 A | . . | 8 A | 0 A | 10 A | 8 A | 10 A | 0 A | 4 A | 2 A | 14 A | 16 |

FIG. 2A

| 50 | 0 A | -4 A | . | . | -4 A | -8 A | 0 A | 6 A | 8 A | 0 A | 0 A | 8 A | 2 A | 16 |
|---|---|---|---|---|---|---|---|---|---|---|---|---|---|---|
| 51 | 0 U | -4 U | . | . | -4 U | -6 U | 10 U | . | . | -4 U | . | 0 U | 0 U | 2 U | . |
| 52 | 0 A | 0 A | . | . | 0 A | 0 A | 10 A | . | . | -4 A | -2 A | 0 A | 4 A | . | . |
| 53 | 4 D | 4 . | . | . | 0 D | 0 . | 12 . | -2 . | -4 . | -2 . | 0 . | . | . | . | . |
| 54 | 0 A | -12 A | . | . | 4 A | -6 A | 10 A | 12 A | 8 A | 0 A | 0 A | 4 A | . | . |
| 55 | 0 U | 0 U | . | . | 0 U | 0 U | 12 U | 2 U | 10 U | 0 U | 0 U | 4 U | . | . |
| 56 | 0 . | -2 . | . | . | . | -8 A | 0 . | 6 . | 10 . | 0 . | . | . | 8 . | 4 A | 20 |
| 57 | 0 . | 4 . | . | . | -4 . | . | 10 A | 2 . | 0 . | 0 D | 4 . | 4 . | 4 . | 8 |
| 58 | 0 A | 6 A | . | . | . | . | 0 A | 10 A | 2 A | -4 A | -2 A | 0 A | 4 A | 4 A | 16 |
| 59 | 0 A | 6 A | . | . | . | . | 0 A | 10 A | 2 A | -4 A | -2 A | 0 A | 4 A | 4 A | 16 |
| 60 | 0 U | . | . | . | 0 U | 0 U | 10 U | 2 U | -4 U | -2 U | . | . | 4 U | 12 U | 16 |
| 61 | 0 A | 0 A | . | . | 0 A | 0 A | 10 A | 2 A | 6 A | 0 A | 8 A | . | . | 12 A | 16 |
| 62 | 0 . | . | . | . | . | 0 . | 0 T | . | . | 10 . | 0 . | 0 . | 0 . | . | . |
| 63 | 0 A | 6 A | . | . | 0 A | -6 A | 10 A | 12 A | . | . | 0 A | . | . | 8 A | 4 A | 16 |
| 64 | 0 A | -8 A | . | . | 0 A | 0 A | 12 A | 4 A | 10 A | 0 A | 0 A | 8 A | 8 A | 20 |
| 65 | 0 U | 4 U | . | . | 0 U | 0 U | 10 U | . | . | 12 U | 0 U | 4 U | 2 U | 12 U | 20 |
| 66 | 0 U | 4 U | . | . | 4 U | 0 U | 10 U | 0 U | 8 U | 0 U | 0 U | 0 U | 2 U | 20 |

FIG. 2B

| | 478B14-848 | 420M9-1395 | D8S1810 | 420M9-3663 | 420M9-116i12 | 420M9-14377 | D8S2319 | 473C15-533 | 473C15-439 | 72H22-36 | 82H10-79B8 | D8S1477 | 82H10-30 |
|---|---|---|---|---|---|---|---|---|---|---|---|---|---|
| A | 0 A | . | . | 22 A | 0 A | -2 A | 0 A | . | . | 8 A | -2 A | 4 A | 12 A | . |
| A | . | . | . | 22 * | 0 . | -2 A | 0 . | . | 0 . | 8 A | -2 A | 4 A | . | . |
| A | 0 A | . | . | 22 A | 0 A | -2 A | 0 A | -4 A | 0 A | 8 A | . | 4 A | 12 A | . |
| A | 0 A | 0 A | . | 22 A | 0 A | -2 A | 0 A | 4 A | 0 A | 8 A | -2 A | 4 A | 12 A | 12 A |
| . | . | . | . | 22 . | . | . | . | 4 . | . | . | . | . | 12 . | . |
| . | 0 . | . | . | 22 . | 0 . | -2 . | 0 . | 4 . | 0 . | 8 . | . | 4 . | 12 . | 12 . |
| . | . | . | 0 D | 22 . | 0 . | 0 T | 0 T | 4 . | 0 . | . | -2 . | 4 . | 12 . | . |
| . | . | . | . | 22 A | 0 A | . | 0 A | 4 A | 0 A | . | . | 4 A | 12 A | . |
| A | . | 0 A | 22 A | 0 A | 0 A | 0 A | . | . | 0 A | 8 A | -2 A | 4 A | . | . |
| A | 8 A | 0 . | . | 22 . | 0 . | 0 . | 0 . | 8 . | 0 . | 4 A | -2 . | 4 . | 12 . | . |
| . | 0 . | 0 . | . | 22 . | 0 . | 0 . | 0 . | 4 . | 0 . | 2 D | -2 . | 4 D | 12 . | 12 . |
| A | 0 A | 0 A | . | 22 A | 0 A | 0 A | 0 A | 8 A | 0 A | 0 A | 0 A | 0 A | 0 A | . |
| . | 0 . | . | . | 22 . | 0 T | 0 . | 0 . | . | 0 . | 8 . | -2 . | 4 . | 12 . | 12 . |
| A | 0 A | 0 A | . | 22 A | 0 A | 0 A | 0 A | . | 0 A | 8 A | . | 4 A | 12 A | . |
| . | 0 . | . | . | 22 . | . | . | 0 E | . | 4 . | 0 . | 8 . | . | . | . |
| . | 0 . | . | . | 22 . | . | . | 0 E | . | 4 . | 0 . | 8 . | . | . | . |
| . | 0 . | 0 A | . | 22 . | 0 . | 0 . | 0 . | 8 . | 0 . | 8 . | 0 . | 0 . | 0 A | . |
| . | 0 . | 0 . | . | 22 . | 0 . | 0 . | 0 . | 0 . | 0 . | 8 . | -2 . | 4 D | 8 . | 8 . |
| A | 0 A | . | . | 22 A | 0 A | 4 A | 0 A | 0 A | 0 A | 8 A | 0 A | -2 A | 4 A | 4 A |
| A | 0 A | . | . | 22 A | 0 A | -2 A | 0 A | 0 A | 0 A | 8 A | . | 4 A | 12 A | 12 A |
| . | 0 . | 0 A | . | 22 . | 0 . | 0 . | 0 . | 4 . | 0 . | 8 . | 0 . | 2 . | -16 . | -16 . |
| . | 0 . | 0 . | . | 22 . | 0 . | 0 . | 0 . | 4 . | 0 . | 8 . | 0 . | 2 . | -16 . | . |
| A | 0 A | . | . | 22 A | 0 A | -2 A | -2 A | 4 A | 0 A | 8 A | -2 A | 2 A | 12 A | . |
| A | 4 A | . | . | 22 A | 0 A | -2 A | 0 A | 4 A | 0 A | 8 A | -2 A | 4 A | 8 A | 8 A |
| U | 2 U | . | . | 22 U | 0 U | 0 U | 0 U | 4 U | 0 U | 8 U | -2 U | 8 U | 16 U | 16 U |
| A | 0 A | 0 A | . | 22 A | 0 A | 0 A | 0 A | 4 A | 0 A | 8 A | -2 A | 4 A | 12 A | 12 A |
| . | 0 . | . | . | 22 . | . | . | . | 4 . | 0 . | 8 . | -2 . | . | . | . |
| A | 0 A | . | . | 22 A | 0 A | -2 A | 0 A | 4 A | 0 A | 2 A | -2 A | 4 A | 12 A | 12 A |
| . | 0 . | 0 A | . | 22 . | . | . | . | 8 D | 0 . | 8 . | 0 . | 0 . | 0 A | . |
| . | 0 U | . | . | 22 U | 0 U | 0 U | 0 U | . | 0 U | 8 U | 0 U | 4 U | . | 12 U |
| . | 0 A | 0 A | . | 22 A | 0 A | 0 A | 0 A | . | 0 A | 8 A | -2 A | 4 A | . | . |
| . | . | . | 0 D | 22 D | 0 D | 0 D | 0 D | 4 . | 0 . | . | 0 D | 4 . | 12 D | . |
| . | . | . | . | 22 U | 0 U | 0 U | 0 U | 4 U | . | . | 0 U | 4 U | 12 U | 12 U |
| . | . | . | . | 22 U | 4 U | 0 U | 0 U | 8 U | . | . | 0 U | 4 U | 12 U | 12 U |
| . | . | 0 A | . | 22 . | 0 . | 0 D | 0 . | 4 A | 0 . | . | 0 D | 4 D | 4 A | . |
| . | 0 . | . | . | 22 . | 0 . | 0 . | 0 . | 4 . | 0 . | 10 . | -2 . | 6 . | . | 12 . |
| A | 0 A | 0 A | . | 22 A | 0 A | 0 A | 0 A | 0 A | 0 A | 2 A | 0 A | 0 A | 0 A | 0 A |
| A | 0 A | . | . | 22 A | 0 A | -12 A | -2 A | 0 A | 0 A | 2 A | 0 A | 0 A | 0 A | 0 A |
| A | 0 A | 0 A | . | 22 A | 0 A | 0 A | 0 A | . | 0 A | 2 A | 0 A | 0 A | 0 A | 0 A |
| . | . | . | . | 22 A | 0 A | 0 A | 0 A | 0 A | . | . | 0 A | 0 A | 0 A | . |
| . | 0 . | . | . | 22 . | 0 . | 0 . | 0 . | 4 . | 0 . | 6 . | -2 . | 4 . | . | . |
| . | 0 . | . | . | 22 . | . | 0 . | . | 4 . | 0 . | 6 . | -2 A | 4 D | . | 8 D |
| U | 0 U | . | . | 22 U | 12 U | 0 U | 0 U | 4 U | 0 U | 8 U | -2 U | 4 U | 12 U | 12 U |
| . | 0 . | 0 . | . | 22 . | 0 . | 0 . | 0 T | . | 0 . | 8 . | 0 . | -2 . | 4 . | . |
| U | 0 U | . | . | 22 U | 0 U | 0 U | 0 U | 4 U | 22 U | 8 U | 0 U | 4 U | 12 U | 12 U |
| A | 0 A | 0 . | . | 22 . | 0 . | 0 . | 0 . | 4 . | 0 D | 10 A | -2 . | 6 . | 12 . | 12 A |
| A | 0 A | . | . | 22 A | 0 A | 0 A | 0 A | 4 A | 0 A | 10 A | -2 A | 6 A | . | 16 A |
| U | 0 U | . | . | 22 U | 4 U | 0 U | 0 U | 4 U | 0 U | 10 U | -2 U | 6 U | 20 U | 20 U |
| A | 0 A | 2 A | . | 22 A | 4 A | 0 A | 8 A | 0 A | . | 10 A | 0 A | 6 A | 16 A | 16 A |

FIG. 2C

|   |   |   |   |   |   |   |   |   |   |   |   |   |   |   |
|---|---|---|---|---|---|---|---|---|---|---|---|---|---|---|
| A | 0 A | . | . | 22 A | 0 A | 0 A | 0 A | -4 A | 0 A | . | . | 4 A | 16 A | 8 A |
| . | 0 U | . | . | 22 U | 0 U | 0 U | 0 U | . . | 0 U | 2 U | -2 U | -2 U | . | -4 U |
| . | . | 0 A | . | 22 A | 0 A | 0 A | 0 A | 4 A | 0 A | . | -2 A | 4 A | 12 A | . |
| . | . | . | 0 . | 22 . | 0 . | 0 . | 0 . | 4 D | 0 . | . | 0 . | -2 . | -4 . | . |
| . | . | . | 2 A | 22 A | 0 A | 0 A | 0 A | 4 A | 22 A | . | 0 A | -2 A | 4 A | . |
| . | . | . | . | 22 U | 0 U | 0 U | 0 U | 4 U | . | . | 0 U | 4 U | 12 U | 12 U |
| A | 0 A | 0 . | . | 22 . | . | 0 . | . | 8 . | 0 . | 6 A | 0 D | 4 . | 16 . | 16 A |
| . | 4 . | . | . | 22 A | 0 . | 0 . | 0 . | 4 D | 0 . | 2 . | -2 D | 4 D | 12 D | 12 D |
| A | -2 A | . | . | 22 A | 0 A | 0 A | -2 A | 4 A | 0 A | 2 A | -2 A | 4 A | 12 A | 12 A |
| A | -2 A | 0 A | . | 22 A | . | 0 A | . | 4 A | 0 A | 2 A | -2 A | 4 A | 12 A | 12 A |
| U | 4 U | . | . | 22 U | 0 U | . | 0 U | . | 0 U | 6 U | 2 U | . | 8 U | 8 U |
| A | 4 A | 0 A | . | 22 A | 0 A | 0 A | 0 A | 4 A | 0 A | 8 A | 0 A | 2 A | -16 A | 8 A |
| . | . | 0 . | . | 22 . | . | 0 . | . | 4 . | 0 . | . | . | 6 . | 12 . | . |
| A | 4 A | . | . | 22 A | . | 0 A | . | 8 A | 0 A | . | . | 4 A | 8 A | 8 A |
| A | 0 A | 0 A | . | 22 A | 0 A | 0 A | 0 A | 4 A | 0 A | 2 A | 0 A | -2 A | 8 A | 8 A |
| U | 6 U | . | . | 22 U | 0 U | 0 U | 0 U | 4 U | 0 U | 8 U | 0 U | 4 U | 12 U | 12 U |
| U | 6 U | . | . | 22 U | 0 U | 0 U | 0 U | 4 U | 0 U | 10 U | 0 U | 4 U | 12 U | 12 U |

|     |     |      |     |      |      |     |      |      |      |      |
|-----|-----|------|-----|------|------|-----|------|------|------|------|
| -4 A | -6 A | . | . | 3 A | 0 A | 0 A | 0 A | 0 A | -2 A | . | . | . | . |
| -2 U | -6 U | . | . | . | 0 U | -2 U | 0 U | 0 U | . | . | . | -12 U |
| -2 A | -6 A | . | . | 3 A | 6 A | 18 A | 0 A | 0 A | 0 A | 0 A | 2 A |
| . | 4 . | . | . | 3 . | . | 20 . | 6 D | 4 . | . | . | 2 D | 0 D |
| 0 A | 0 A | . | . | 9 A | 6 A | -2 A | 2 A | 0 A | 0 A | -2 A | 4 A |
| 0 U | 0 U | . | . | 3 U | 6 U | . | . | 6 U | . | . | 2 U |
| 0 D | -6 . | 20 A | 3 . | 6 . | 20 D | 0 . | 0 . | . | . | 0 D | 2 . |
| -2 D | -6 D | 0 . | . | . | -2 . | . | . | . | 0 D | 0 . | 0 . | 0 . |
| -2 A | -6 A | . | . | 3 A | 6 A | 18 A | 0 A | 0 A | . | -2 A | 2 A |
| -2 A | -6 A | . | . | 3 A | 6 A | 18 A | 0 A | 0 A | . | 6 A | 2 A |
| 0 U | 0 U | . | . | 9 U | 2 U | 18 U | 2 U | 6 U | . | -2 U | 2 U |
| . | 0 A | . | . | 0 A | 4 A | 22 A | 2 A | 10 A | . | -2 A | . |
| . | 0 . | . | . | 3 T | 6 . | . | . | . | 0 . | 2 . | 2 . | 8 . |
| . | . | . | . | 3 A | . | 20 A | 2 A | 6 A | 0 A | . | 12 A |
| . | 0 A | . | . | . | -2 A | 24 A | 0 A | 6 A | -2 A | -2 A | -4 A |
| 0 U | 0 U | 20 U | . | . | 4 U | 20 U | 2 U | 8 U | . | 4 U | -8 U |
| 0 U | 4 U | . | . | 3 U | 4 U | . | . | . | 6 U | . | -2 U | -2 U |

FIG. 2F

| | SNP8NRG85307DEL25 | SNP8NRG103492 | 29H12-121L21 | SNP8NRG157556 | SNP8NRG221132 | SNP8NRG221533 | SNP8NRG241930 | SNP8NRG243177 | SNP8NRG433E1006 | 478B14-848 | 420M9-1395 | D8S1810 | SNP8NRG444511 | SNP8NRG449280 | TSC0707270 | TSC0707290 | | Haplotype frequency Controls N=394 | Affecteds N=478 | (P* value) | Independent Affecteds N=402 | (P value) |
|---|---|---|---|---|---|---|---|---|---|---|---|---|---|---|---|---|---|---|---|---|---|---|
| HapA | 5 | 2 | 8 | 1 | 2 | 1 | 2 | 3 | 2 | 0 | 0 | 22 | 0 | 0 | 3 | 0 | | 2.4% | 5.3% | (1.0x10⁻³) | 4.4% | (1.3x10⁻²) |
| HapB | 5 | 3 | 0 | 3 | 2 | 1 | 2 | 3 | 2 | 0 | 0 | 18 | 3 | 0 | 0 | 2 | | 3.2% | 5.9% | (8.5x10⁻³) | 6.1% | (4.1x10⁻³) |
| HapC1 | 5 | 3 | 0 | 3 | 2 | 1 | 2 | 3 | 2 | 0 | 0 | 16 | 3 | 0 | 0 | 2 | | 0.6% | 2.9% | (8.4x10⁻⁴) | 2.3% | (2.6x10⁻³) |
| HapC2 | | | | | | | | | | | | | 0 | 0 | 3 | 0 | | | | | | |
| core | * | 2 | 1 | * | 2 | 1 | 2 | 3 | 2 | 0 | 0 | * | | | | | | 7.5% | 15.4% | (3.7x10⁻⁶) | 14.4% | (8.7x10⁻⁵) |

FIG. 6

Splice variants for Neuregulin 1, mRNA / cDNA variants

| Exon start | | 244205 | 244641 | 826010 | 826308 | 1034243 | 1153295 | 1200722 | 1200888 | 1210623 | 1219543 | 1221864 | 1252254 | 1326782 |
|---|---|---|---|---|---|---|---|---|---|---|---|---|---|---|
| Exon end | Variant | 244348 | 245646 | 826101 | 826355 | 1034321 | 1153886 | 1201065 | 1201065 | 1210744 | 1219593 | 1221914 | 1253413 | 1327071 |
| NRG1Locus050201 | | Novel | | Novel | Novel | Novel | | Novel | | | | | | Novel |
| Exons(E) | | E144 | E1006 | E92 | E48 | E79 | E592 | E344 | E178 | E122 | E51a | E51b | E1160 | E290 |
| Exon type | | 5p | 5p | 5p | 5p | ie | 5p | 5p | ie | ie | ie | ie | 5p | 5p |
| Start/Term | | S108 | S262 | S62 | no S/T | | S493 | S190 | (S24) | | | | S494 | S250 |
| Genomic order | | 1 | 2 | 3 | 4 | 5 | 6 | 7a | 7b | 8 | 9 | 10 | 11 | 12 |
| mRNA/cDNA variants | | | | | | | | | | | | | | |
| L41827 | v1 | | | | | | | | | | | | | |
| NM013959 | | | | | | | | | | | | x | | |
| L12260 | v2 | x | | | | | | | | | | x | | |
| NM013962 | | | 29x | | | | | | | | | | | |
| NM013961 | v3 | | | | | | 100x | | | | x | | | |
| M94168 | | | | | | | x | | | | x | | | |
| NM013958 | | | | | | | x | | | | x | | | |
| HSU2327 | v4 | | | | | | | | | 87x | x | | | |
| M94167 | v5 | | | | | | 33x | | x | x | x | | | |
| NM013957 | | | | | | | 33x | | x | x | x | | | |
| U02328 | v6 | | | | | | | | | | x | | | |
| M94166 | v7 | | | | | | 401x | | x | x | x | | | |
| NM013956 | | | | | | | 401x | | x | x | x | | | |
| U02325 | v8 | | | | | | | | | | x | | | |
| U02326 | v9 | | | | | | 385x | | x | x | x | | | |
| NM013960 | | | | | | | 385x | | x | x | x | | | |
| M94165 | v10 | | | | | | x | | | | x | | | |
| NM013964 | | | | | | | 361x | | x | x | x | | | |
| NM004495 | v11 | | | | | | 56x | | x | x | x | | | |

Nomenclature = Initials of person who found splice variant -- Name of clone -- Well in DNA plate -- Seq. gel number -- Origin of sample
C = Cerebellum (from human brain)
A = Adenocarcenoma (MDA231)
c = means that we used a clamped primer
M = Marathon cDNA library from whole brain
M(H) = Marathon cDNA library from hippocampus
R = cDNA library from fetal brain
K3 = control 3 (RNA isolated from the blood of control individuals)
H = Hippocampus

FIG. 9A

Splice variants for Neuregulin 1, mRNA / cDNA variants

| Exon start | | | 1332978 | 1332978 | 1347040 | 1347707 | 1347707 | 1354621 | 1359432 | 1361463 | 1364363 | 1365257 | 1365257 | 1368281 | 1368811 |
|---|---|---|---|---|---|---|---|---|---|---|---|---|---|---|---|
| Exon end | Variant | | 1333107 | 1333652 | 1347107 | 1347765 | 1348257 | 1354644 | 1359534 | 1361589 | 1364493 | 1365463 | 1366044 | 1368422 | 1369656 |
| NRG1Locus050201 | | | | | | | | | | | | | Novel | | |
| Exons(E) | | | E130 | E675 | E68 | E59 | E551 | E24 | E103 | E127 | E131 | E207 | E788 | E142 | E846 |
| Exon type | | | ie | 3p | ie | ie | 3p | ie | ie | ie | ie | ie | 3p | ie | 3p |
| Start/Term | | | | T132 | | | T92 | | | | | | T209 | T119 | T653 |
| Genomic order | | | 13a | 13b | 14 | 15a | 15b | 16 | 17 | 18 | 19 | 20a | 20b | 21 | 22 |
| mRNA/cDNA variants | | | | | | | | | | | | | | | |
| L41827 | v1 | | x | | | | | | | | | | | | |
| NM013959 | v2 | | x | | | | | | | | | | | | |
| L12260 | | | x | | | | | | | | | | | | |
| NM013962 | | | x | | | | x550 | | | | | | | | |
| NM013961 | | | x | | | | x550 | | | | | | | | |
| M94168 | v3 | | x | | | | x174 | | | | | | | | |
| NM013958 | v4 | | x | | | | x | | | | | | | | |
| HSU2327 | | | x | | x | | x579 | | | | | | | | |
| M94167 | v5 | | x | | x | x | x550 | | x | x | x | x | | | x758 |
| NM013957 | | | x | | x | x | | | x | x | x | x | | | x764 |
| U02328 | v6 | | x | | x | x | | x | x | x | x | x | | | x |
| M94166 | v7 | | x | | x | x | | x | x | x | x | x | | | x808 |
| NM013956 | | | x | | x | | | x | x | x | x | x | | | x808 |
| U02325 | v8 | | 55x | | | | | x | x | x | x | x | | | x335 |
| U02326 | v9 | | x | | | | | x | x | x | x | x | | x | x247 |
| NM013960 | | | x | | | | | | x | x | x | x | | x | x247 |
| M94165 | v10 | | x | | | | | | x | x | x | x | | | x808 |
| NM013964 | | | x | | | | | | x | x | x | x | | | x808 |
| NM004495 | v11 | | | x | | | | | | | | | | | |

FIG. 9B

Splice variants for Neuregulin 1, Novel cDNA variants

| Exon start | | | 244205 | 244641 | 826010 | 826308 | 1034243 | 1153295 | 1200722 | 1200888 | 1210623 | 1219543 |
|---|---|---|---|---|---|---|---|---|---|---|---|---|
| Exon end | | | 244348 | 245646 | 826101 | 826355 | 1034321 | 1153886 | 1201065 | 1201065 | 1210744 | 1219593 |
| NRG1Locus050201 | | | Novel | | Novel | Novel | Novel | | Novel | | | |
| Exons(E) | | | E144 | E1006 | E92 | E48 | E79 | E592 | E344 | E178 | E122 | E51a |
| Exon type | | | 5p | 5p | 5p | 5p | ie | 5p | 5p | ie | ie | ie |
| Start/Term | | | S108 | S262 | S62 | no S/T | | S493 | S190 | (S24) | | |
| | Variant | Lab book nr (page) | | | | | | | | | | |
| Genomic order | | | 1 | 2 | 3 | 4 | 5 | 6 | 7a | 7b | 8 | 9 |
| Novel cDNA variants | | | | | | | | | | | | |
| OG-6_17_(17/E17)-11078-fbM | v12 | | x | | x | | | | | | | |
| ACF-68_45-8241/8242-M(H) | v13 | | | | | | | | x | | | x |
| ACF-69_52-8241/8242-M(H) | v14 | | | | | | | | x | | | x |
| ACF-6_30_8847/8848-M | v15 | 18(73) | x | | | | | | | x | | |
| ACF-6_29_8847/8848-M | v16 | 18(83) | | | | | | | | | | |
| ACF-6_28_8847-M | v17 | 18(99) | | | | | | | | | | |
| ACF-2_11_8847/8848+CS-M | v18 | 27(78) | | | | | | | | | | |
| ACF-10_41_8847/8848-M | v19 | 27(30, 79) | | | | | | | | | | |
| ACF-20_09-9246-M | v20 | 27(22) | xc | | | | | | | 49x | x | |
| ACF-1_03-9248/9249-M | v21 | 27(22) | xc | | | | | | | 47x | x | x |
| ACF-1_06-9423/9424-M | v22 | 27(23) | xc | | | | | | | 65x | x | x |
| ACF-48R_22-9281-R | v23 | 27(35, 74) | | | | | | | | x | x | |
| ACF-3R_19-9249-M | v24 | | xc | | | | x | | | 47x | x | x |
| ACF-2R_09-9424-M | v25 | | | | | | | | | x | x | x |
| SB-11_05-9394-C | v26 | 360-25(33, 64) | | | | | | 518x | | x | x | |
| SB-20_62-9394-A | v27 | 360-25(33, 65) | | | | | | 514x | | x | x | |
| SB-20_90-9585-C | v28 | 360-25(33, 66) | | | 16x | | | | | x | x | x |
| SB-6_16-9689-C | v29 | 360-25(63, 75) | | | | | | | | 46x | x | |
| SB-9_26-9690-C | v30 | 360-25(63, 78) | | 957x | | | | | | x | x | x |
| OG-140-80-10093/10094-M | v31 | 23(72) | | 957x | | | | | | x | x | |
| SB-9B-b_28-11539-C | v32 | 396-31(84-85) | | | 73x | | x | | | x | x | x |
| SB-9A-a_04-11538-C | v33 | 396-31(83) | | | 16x | | | | | | | |
| SB-16A-c_61-11538-K3 | v34 | 396-31(83) | | | | | | | | | | |
| SB-18A-a_74-11538-A | v35 | 396-31(83) | | | | | | | | | | |

FIG. 9C

Splice variants for Neuregulin 1, Novel cDNA variants

| Exon start | | | 1221864 | 1252254 | 1326782 | 1332978 | 1332978 | 1347040 | 1347707 | 1347707 | 1354621 | 1359432 |
|---|---|---|---|---|---|---|---|---|---|---|---|---|
| Exon end | | | 1221914 | 1253413 | 1327071 | 1333107 | 1333652 | 1347107 | 1347765 | 1348257 | 1354644 | 1359534 |
| NRG1Locus050201 | | | | | Novel | | | | | | | |
| Exons(E) | | | E51b | E1160 | E290 | E130 | E675 | E68 | E59 | E551 | E24 | E103 |
| Exon type | | | ie | 5p | 5p | ie | 3p | ie | ie | 3p | ie | ie |
| Start/Term | | | | S494 | S250 | | T132 | | | T92 | | |
| Genomic order | | | 10 | 11 | 12 | 13a | 13b | 14 | 15a | 15b | 16 | 17 |
| Novel cDNA variants | Variant | Lab book nr (page) | | | | | | | | | | |
| OG-6_17_(17/E17)-11078-fbM | v12 | | x | | | | | | | | | |
| ACF-68_45-8241/8242-M(H) | v13 | | x | | | | | | | | | |
| ACF-69_52-8241/8242-M(H) | v14 | | | | | | | | | | | |
| ACF-6_30_8847/8848-M | v15 | 18(73) | | | | x | | | x | | | x52 |
| ACF-6_29_8847/8848-M | v16 | | | 835x | | x | | | x | | x | x52 |
| ACF-6_28_8847-M | v17 | 18(83) | | | x | x | | | x | | x | x52 |
| ACF-2_11_8847/8848+CS-M | v18 | 18(99) | | | | | | | | x551 | | 73x |
| ACF-10_41_8847/8848-M | v19 | 27(78) | | 1094x | 228x | x | | | x30 | | | xc |
| ACF-20_09-9246-M | v20 | 27(30, 79) | | | | x | | | | x550 | | |
| ACF-1_03-9248/9249-M | v21 | 27(22) | | | | x | | | | x542 | | |
| ACF-1_06-9423/9424-M | v22 | 27(22) | x | | | x | | | | | | |
| ACF-48R_22-9281-R | v23 | 27(23) | x | | | x | | | x | | x | x |
| ACF-3R_19-9249-M | v24 | 27(35, 74) | | | | | | | | | | |
| ACF-2R_09-9424-M | v25 | | | | | x | x300 | | | | | |
| SB-11_05-9394-C | v26 | 360-25(33, 64) | | | | x | | | | x223 | | |
| SB-20_62-9394-A | v27 | 360-25(33, 65) | | | | x | | | x | | x | x51 |
| SB-20_90-9585-C | v28 | 360-25(33, 66) | | | | x90 | | | | | | |
| SB-6_16-9689-C | v29 | 360-25(63, 75) | | | | x90 | | | | | | |
| SB-9_26-9690-C | v30 | 360-25(63, 78) | | | | x90 | | | | | | |
| OG-140-80-10093/10094-M | v31 | 23(72) | | | | x | | | x | | | |
| SB-9B-b_28-11539-C | v32 | 396-31(84-85) | | | | x90 | | | | | | |
| SB-9A-a_04-11538-C | v33 | 396-31(83) | | | | x74 | | | | | | |
| SB-16A-c_61-11538-K3 | v34 | 396-31(83) | | 1011x | | x | | | x | | | x52 |
| SB-18A-a_74-11538-A | v35 | 396-31(83) | | | 228x | x | | x | | | | x45 |

FIG. 9D

Splice variants for Neuregulin 1, Novel cDNA variants

| Exon start | | 1361463 | 1364363 | 1365257 | 1365257 | 1368281 | 1368811 |
|---|---|---|---|---|---|---|---|
| Exon end | | 1361589 | 1364493 | 1365463 | 1366044 | 1368422 | 1369656 |
| NRG1Locus050201 | | | | | Novel | | |
| | Variant / Lab book nr (page) | | | | | | |
| Exons(E) | | E127 | E131 | E207 | E788 | E142 | E846 |
| Exon type | | ie | ie | ie | 3p | ie | 3p |
| Start/Term | | | | | T209 | T119 | T653 |
| Genomic order | | 18 | 19 | 20a | 20b | 21 | 22 |
| Novel cDNA variants | | | | | | | |
| OG-6_17_(17/E17)-11078-fbM | v12 | | | | | | |
| ACF-68_45-8241/8242-M(H) | v13 | | | | | | |
| ACF-69_52-8241/8242-M(H) | v14 | | | | | | |
| ACF-6_30_8847/8848-M | v15 | 18(73) | | | | | |
| ACF-6_29_8847/8848-M | v16 | | | | | | |
| ACF-6_28_8847-M | v17 | 18(83) | | | | | |
| ACF-2_11_8847/8848+CS-M | v18 | 18(99) x | | | | | |
| ACF-10_41_8847/8848-M | v19 | 27(78) | | | x | | |
| ACF-20_09-9246-M | v20 | 27(30, 79) | | | | | |
| ACF-1_03-9248/9249-M | v21 | 27(22) | | | | | |
| ACF-1_06-9423/9424-M | v22 | 27(22) | | | | | |
| ACF-48R_22-9281-R | v23 | 27(23) x109 | | | | | |
| ACF-3R_19-9249-M | v24 | 27(35, 74) | | | | | |
| ACF-2R_09-9424-M | v25 | | | | | | |
| SB-11_05-9394-C | v26 | 360-25(33, 64) | | | | | |
| SB-20_62-9394-A | v27 | 360-25(33, 65) | x | | | | |
| SB-20_90-9585-C | v28 | 360-25(33, 66) | | | | | |
| SB-6_16-9689-C | v29 | 360-25(63, 75) | | | | | |
| SB-9_26-9690-C | v30 | 360-25(63, 78) | | | | | |
| OG-140-80-10093/10094-M | v31 | 23(72) | | | | | |
| SB-9B-b_28-11539-C | v32 | 396-31(84-85) | | | | | |
| SB-9A-a_04-11538-C | v33 | 396-31(83) | | | | | |
| SB-16A-c_61-11538-K3 | v34 | 396-31(83) | | | | | |
| SB-18A-a_74-11538-A | v35 | 396-31(83) | | | | | |

FIG. 9E

NEUREGULIN-1 TRANSGENIC MOUSE AND METHODS OF USE

RELATED APPLICATIONS

This application is a continuation-in-part of U.S. application Ser. No. 09/946,807, filed Sep. 5, 2001 now abandoned, which is a continuation-in-part of International Application No. PCT/US01/06377, which designated the United States and was filed on Feb. 28, 2001, published in English, and is a continuation-in-part of U.S. application Ser. No. 09/795,668 filed Feb. 28, 2001 now abandoned, which is a continuation-in-part of U.S. application Ser. No. 09/515,716, filed Feb. 28, 2000 now abandoned. The entire teachings of the above applications are incorporated herein by reference.

BACKGROUND OF THE INVENTION

Schizophrenia is a devastating form of psychopathology, with a lifetime prevalence worldwide of 0.5%-1%. Twin and adoption studies suggest that both genetic and environmental factors influence susceptibility (see, e.g., Tsuang, M. T. et al., *Schizophr. Res.* 4(2):157-71 (1991); Tienari, P. J. and Wynne, L. C., *Ann. Med.* 26(4):233-7 (1994); Franzek, E. and Beckmann, H., *Am. J. Psychiatry* 155(1):76-83 (1998); Tsuang, M. T., *J. Biomed. Sci.* 5(1):28-30 (1998)). Among first-degree relatives, the risk has been reported to vary from 6% in parents, to 10% in siblings, and to 13% in children of schizophrenic individuals; if one of the parents is also schizophrenic, the risk to siblings increases to 17%, and children of two schizophrenics have a risk of 46% of developing the illness (McGue, M. and Gottesmann, I. I., *Eur. Arch. Psychiatry Clin. Neurosci* 240:174-181 (1991); see also, e.g., Lim, L. C. and Sim, L. P., *Singapore Med. J.* 33(6):645-7 (1992)). The mode of transmission, however, remains uncertain.

Reports of suggestive linkage to several loci have been published, including loci on chromosomes 3, 5, 6, 8, 10, 13, 20, 22 and the X chromosome (see, e.g., for chromosomes 3p and 8p, Pulver, A. E., et al., *Am. J. Med. Genet.* 60(4):252-60 (1995); for chromosomes 5q, 6p and 8p, Kendler, K. S. et al., *Am. J. Med. Genet.* 88(1):29-33 (1999); for chromosomes 5q, 6p, 8p, 20p and 22q, Hovatta, I. et al., *Mol. Psychiatry.* 3(5): 452-7 (1998); for chromosome 6p, Schwab, S. G. et al., *Nat. Genet.* 11(3):325-7 (1995), Brzustowicz, L. M. et al., *Am. J. Hum. Genet.* 61(6):1388-96 (1997) and Cao, Q. et al., *Genomics* 43(1):1-8 (1997); for chromosomes 6 and 8, Straub, R. E. et al., *Cold Spring Harbor Symp. Quant. Biol* 61I:823-33 (1996); for chromosome 8, Kendler, K S. et al., *Am. J. Psychiatry* 153(12):1534-40 (1996); for chromosome 10, Straub, R. E. et al., *Am. J. Med. Genet.* 81(4):296-301 (1998) and Schwab, S. G. et al., *Am. J. Med. Genet.* 81(4): 302-307 (1998); for chromosome 13, Lin, M. W. et al., *Psyciatr. Genet.* 5(3):117-26 (1995); Lin, M. W. et al., *Hum. Genet.* 99(3):417-420 (1997) and Blouin, J. L. et al., *Nat. Genet.* 20(1):70-73 (1993) (8 and 13); for chromosome 22, Gill, M. et al., *Am. J. Med. Genet.* 67(1):40-45 (1996) and Bassett, A. S. et al., *Am. J. Med. Genet.* 81(4):328-37 (1998); and for the X chromosome, Milunsky, J. et al., *Clin. Genet.* 55(6):455-60 (1999)).

SUMMARY OF THE INVENTION

The present invention relates to isolated nucleic acid molecules comprising the neuregulin 1 gene (NRG1). In one embodiment, the isolated nucleic acid molecule comprises a nucleotide sequence selected from the group consisting of SEQ ID NO: 1 and the complement of SEQ ID NO: 1. The invention further relates to a nucleic acid molecule which hybridizes under high stringency conditions to a nucleotide sequence selected from the group consisting of SEQ ID NO: 1 and the complement of SEQ ID NO: 1. The invention additionally relates to isolated nucleic acid molecules (e.g., cDNA molecules) encoding an NRG1 polypeptide (e.g., encoding any one of SEQ ID NO: 2-5 and 10-39, or another splicing variant of NRG1 polypeptide).

The invention further provides a method for assaying a sample for the presence of a nucleic acid molecule comprising all or a portion of NRG1 in a sample, comprising contacting said sample with a second nucleic acid molecule comprising a nucleotide sequence encoding an NRG1 polypeptide (e.g., SEQ ID NO: 1 or the complement of SEQ ID NO: 1; a nucleotide sequence encoding any one of SEQ ID NO: 2-5 or 10-39, or another splicing variant of NRG1 polypeptide), or a fragment or derivative thereof, under conditions appropriate for selective hybridization. The invention additionally provides a method for assaying a sample for the level of expression of an NRG1 polypeptide, or fragment or derivative thereof, comprising detecting (directly or indirectly) the level of expression of the NRG1 polypeptide, fragment or derivative thereof.

The invention also relates to a vector comprising an isolated nucleic acid molecule of the invention operatively linked to a regulatory sequence, as well as to a recombinant host cell comprising the vector. The invention also provides a method for preparing a polypeptide encoded by an isolated nucleic acid molecule described herein (an NRG1 polypeptide), comprising culturing a recombinant host cell of the invention under conditions suitable for expression of said nucleic acid molecule.

The invention further provides an isolated polypeptide encoded by isolated nucleic acid molecules of the invention (e.g., NRG1 polypeptide), as well as fragments or derivatives thereof. In a particular embodiment, the polypeptide comprises the amino acid sequence of any one of SEQ ID NO: 2-5 or 10-39. In another embodiment, the polypeptide is another splicing variant of an NRG1 polypeptide. The invention also relates to an isolated polypeptide comprising an amino acid sequence which is greater than about 90 percent identical to the amino acid sequence of any one of SEQ ID NO: 2-5 or 10-39.

The invention also relates to an antibody, or an antigen-binding fragment thereof, which selectively binds to a polypeptide of the invention, as well as to a method for assaying the presence of a polypeptide encoded by an isolated nucleic acid molecule of the invention in a sample, comprising contacting said sample with an antibody which specifically binds to the encoded polypeptide.

The invention further relates to methods of diagnosing a predisposition to schizophrenia. The methods of diagnosing a predisposition to schizophrenia in an individual include detecting the presence of a mutation in NRG1, as well as detecting alterations in expression of an NRG1 polypeptide, such as the presence of different splicing variants of NRG1 polypeptides. The alterations in expression can be quantitative, qualitative, or both quantitative and qualitative.

The invention also pertains to methods of diagnosing a susceptibility to schizophrenia in an individual, comprising screening for an at-risk haplotype in neuregulin 1 gene that is more frequently present in an individual susceptible to schizophrenia (affected), compared to the frequency of its presence in a healthy individual (control), wherein the presence of the haplotype is indicative of a susceptibility to schizophrenia.

The invention additionally relates to an assay for identifying agents which alter (e.g., enhance or inhibit) the activity or expression of one or more NRG1 polypeptides. For example, a cell, cellular fraction, or solution containing an NRG1 polypeptide or a fragment or derivative thereof, can be contacted with an agent to be tested, and the level of NRG1 polypeptide expression or activity can be assessed. The activity or expression of more than one NRG1 polypeptides can be assessed concurrently (e.g., the cell, cellular fraction, or solution can contain more than one type of NRG1 polypeptide, such as different splicing variants, and the levels of the different polypeptides or splicing variants can be assessed).

In another embodiment, the invention relates to assays to identify polypeptides which interact with one or more NRG1 polypeptides. In a yeast two-hybrid system, for example, a first vector is used which includes a nucleic acid encoding a DNA binding domain and also a nucleic acid encoding an NRG1 polypeptide, splicing variant, or fragment or derivative thereof, and a second vector is used which includes a nucleic acid encoding a transcription activation domain and also a nucleic acid encoding a polypeptide which potentially may interact with the NRG1 polypeptide, splicing variant, or fragment or derivative thereof (e.g., a NRG1 polypeptide binding agent or receptor). Incubation of yeast containing both the first vector and the second vector under appropriate conditions allows identification of polypeptides which interact with the NRG1 polypeptide or fragment or derivative thereof, and thus can be agents which alter the activity of expression of an NRG1 polypeptide.

Agents that enhance or inhibit NRG1 polypeptide expression or activity are also included in the current invention, as are methods of altering (enhancing or inhibiting) NRG1 polypeptide expression or activity by contacting a cell containing NRG1 and/or polypeptide, or by contacting the NRG1 polypeptide, with an agent that enhances or inhibits expression or activity of NRG1 polypeptide.

Additionally, the invention pertains to pharmaceutical compositions comprising the nucleic acids of the invention, the polypeptides of the invention, and/or the agents that alter activity of NRG1 polypeptide. The invention further pertains to methods of treating schizophrenia, by administering NRG1 therapeutic agents, such as nucleic acids of the invention, polypeptides of the invention, the agents that alter activity of NRG1 polypeptide, or compositions comprising the nucleic acids, polypeptides, and/or the agents that alter activity of NRG1 polypeptide.

The invention further relates to methods of assessing an agent of interest for neuroleptic activity, by administering the agent to a mouse that is hypomorphic for the neuregulin gene or for the ErbB4 gene and which exhibits abnormal behavior (e.g., hyperactivity, or alterations in social interaction or prepulse inhibition), and assessing the behavior of the mouse (e.g., by an open field test) in response to the agent to determine if there is a decrease in abnormal behavior, wherein a statistically significant decrease in abnormal behavior is associated with neuroleptic activity of the agent. Similarly, the invention also relates to methods for identifying a potential therapeutic agent for use in the treatment of schizophrenia, by administering an agent to a mouse that is hypomorphic for the neuregulin gene or for the ErbB4 gene and which exhibits abnormal behavior, and assessing the behavior of the mouse in response to the agent to determine if there is a decrease in abnormal behavior, wherein a statistically significant decrease in abnormal behavior indicates that the agent is a potential therapeutic agent for use in the treatment of schizophrenia.

BRIEF DESCRIPTION OF THE DRAWINGS

FIG. 2 depicts haplotypes found in individuals affected with schizophrenia. Portions which are found in multiple haplotypes are depicted by backward slashes.

FIG. 6 shows four haplotypes, defined by 12 SNPs and 4 microsatellite markers, were individually found in excess in the schizophrenia patients with similar relative risk. The common core for these haplotypes, defined by 5 SNPs and 2 microsatellite markers, is shown at the bottom. The frequency for each haplotype in all affected individuals, independent affected individuals and controls is indicated in the panel on the right. The distance between the markers flanking possible recombination breakpoints (arrows) is 290 kb.

FIG. 7A shows NRG1TM hypomorphic mice and FIG. 7B shows ErbB4 hypomorphic mice. Data has been binned into 5 min intervals over the 30 min observation period. Distance traveled was significantly increased in both NRG1TM and ErbB4 male mice in comparison to litter-mate controls (N=21 NRG1TM mice and 22 litter-mate controls, P=0.035; N=39 ErbB4 mice and 22 litter-mate controls, P=0.027). Open field activity was monitored. Error bars indicate the standard error of the mean (±SEM).

FIGS. 9A to 9E are a table identifying splice variants for Neuregulin 1. FIGS. 9A and 9B show mRNA/cDNA variants. FIGS. 9C, 9D and 9E show novel cDNA variants.

DETAILED DESCRIPTION OF THE INVENTION

Figure 1:
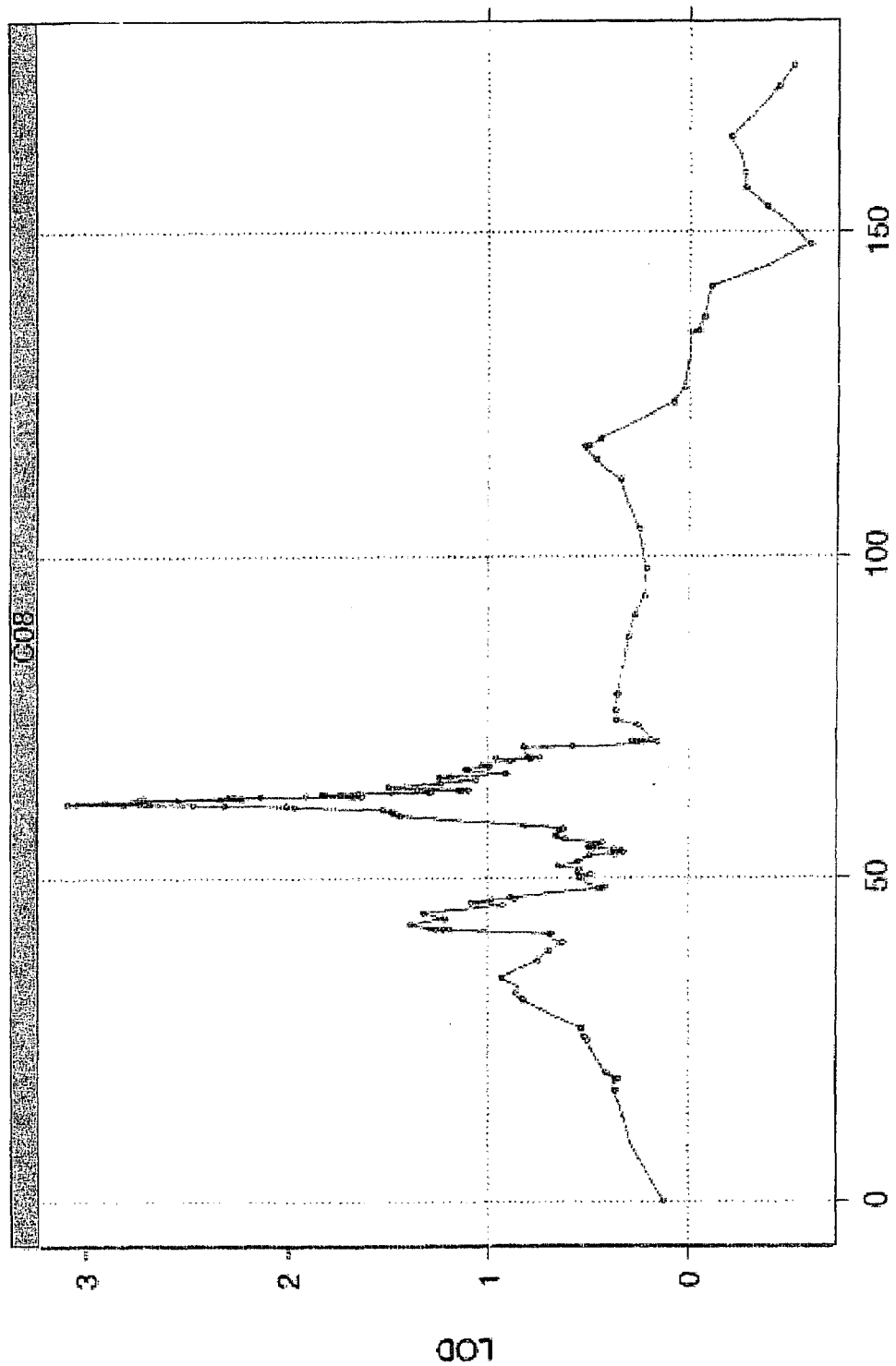
FIG. 1 is a graphic representation of the nonparametric multipoint LOD score for the schizophrenia locus on 8p21-p12.

As described herein, Applicants have used linkage and haplotype analyses to identify a disease susceptibility gene for schizophrenia residing in a 1.5 Mb segment on chromosome 8p12. The gene is neuregulin 1 gene (NRG1). The full sequence of the neuregulin 1 gene is shown in SEQ ID NO: 1. Microsatellite markers and single nucleotide polymorphisms (SNPs) in the sequence are shown in Tables 2 and 3 Table 4 shows the splice variants for neuregulin 1 exons.

Nucleic Acids of the Invention

Accordingly, the invention pertains to an isolated nucleic acid molecule comprising the mammalian (e.g., primate or human) neuregulin 1 gene (NRG1). The term, "NRG1," as used herein, refers to an isolated nucleic acid molecule in the 8p21-p12 locus, which is associated with a susceptibility to schizophrenia, and also to an isolated nucleic acid molecule (e.g., cDNA or the gene) that encodes an NRG1 polypeptide (e.g., the polypeptide having any one of SEQ ID NO:2-5 or 10-39, or another splicing variant of an NRG1 polypeptide). In a preferred embodiment, the isolated nucleic acid molecule comprises SEQ ID NO: 1 or the complement of SEQ ID NO: 1. In another preferred embodiment, the isolate nucleic acid molecule comprises the sequence of SEQ ID NO: 1 or the complement of SEQ ID NO: 1, except that one or more single nucleotide polymorphisms as shown in Tables 2 and 3 are also present.

The isolated nucleic acid molecules of the present invention can be RNA, for example, mRNA, or DNA, such as cDNA and genomic DNA. A "neuregulin 1 nucleic acid" ("NRG1-nucleic acid"), as used herein, refers to a nucleic acid molecule (RNA, mRNA, cDNA, or genomic DNA, either single- or double-stranded) encoding NRG1. DNA molecules can be double-stranded or single-stranded; single stranded RNA or DNA can be either the coding, or sense, strand or the non-coding, or antisense, strand. The nucleic acid molecule can include all or a portion of the coding sequence of the gene and can further comprise additional non-coding sequences such as introns and non-coding 3' and 5' sequences (including regulatory sequences, for example). Additionally, the nucleic acid molecule can be fused to a marker sequence, for example, a sequence that encodes a polypeptide to assist in isolation or purification of the polypeptide. Such sequences include, but are not limited to, those which encode a glutathione-S-transferase (GST) fusion protein and those which encode a hemagglutinin A (HA) polypeptide marker from influenza.

An "isolated" nucleic acid molecule, as used herein, is one that is separated from nucleic acids which normally flank the gene or nucleotide sequence (as in genomic sequences) and/or has been completely or partially purified from other transcribed sequences (e.g., as in an RNA library). For example, an isolated nucleic acid of the invention may be substantially isolated with respect to the complex cellular milieu in which it naturally occurs, or culture medium when produced by recombinant techniques, or chemical precursors or other chemicals when chemically synthesized. In some instances, the isolated material will form part of a composition (for example, a crude extract containing other substances), buffer system or reagent mix. In other circumstances, the material may be purified to essential homogeneity, for example as determined by PAGE or column chromatography such as HPLC. Preferably, an isolated nucleic acid molecule comprises at least about 50, 80 or 90% (on a molar basis) of all macromolecular species present. With regard to genomic DNA, the term "isolated" also can refer to nucleic acid molecules which are separated from the chromosome with which the genomic DNA is naturally associated. For example, the isolated nucleic acid molecule can contain less than about 5 kb, 4 kb, 3 kb, 2 kb, 1 kb, 0.5 kb or 0.1 kb of nucleotides which flank the nucleic acid molecule in the genomic DNA of the cell from which the nucleic acid molecule is derived.

The nucleic acid molecule can be fused to other coding or regulatory sequences and still be considered isolated. Thus, recombinant DNA contained in a vector is included in the definition of "isolated" as used herein. Also, isolated nucleic acid molecules include recombinant DNA molecules in heterologous host cells, as well as partially or substantially purified DNA molecules in solution. "Isolated" nucleic acid molecules also encompass in vivo and in vitro RNA transcripts of the DNA molecules of the present invention. An isolated nucleic acid molecule or nucleotide sequence can include a nucleic acid molecule or nucleotide sequence which is synthesized chemically or by recombinant means. Therefore, recombinant DNA contained in a vector are included in the definition of "isolated" as used herein. Also, isolated nucleotide sequences include recombinant DNA molecules in heterologous organisms, as well as partially or substantially purified DNA molecules in solution. In vivo and in vitro RNA transcripts of the DNA molecules of the present invention are also encompassed by "isolated" nucleotide sequences. Such isolated nucleotide sequences are useful in the manufacture of the encoded polypeptide, as probes for isolating homologous sequences (e.g., from other mammalian species), for gene mapping (e.g., by in situ hybridization with chromosomes), or for detecting expression of the gene in tissue (e.g., human tissue), such as by Northern blot analysis The present invention also pertains to variant nucleic acid molecules which are not necessarily found in nature but which encode an NRG1 polypeptide (e.g., a polypeptide having the amino acid sequence of any one of SEQ ID NO:2-5 or 10-39, or another splicing variant of NRG1 polypeptide). Thus, for example, DNA molecules which comprise a sequence that is different from the naturally-occurring nucleotide sequence but which, due to the degeneracy of the genetic code, encode an NRG1 polypeptide of the present invention are also the subject of this invention. The invention also encompasses nucleotide sequences encoding portions (fragments), or encoding variant polypeptides such as analogues or derivatives of the NRG1 polypeptide. Such variants (also referred to herein as "derivatives") can be naturally-occurring, such as in the case of allelic variation or single nucleotide polymorphisms, or non-naturally-occurring, such as those induced by various mutagens and mutagenic processes. Intended variations include, but are not limited to, addition, deletion and substitution of one or more nucleotides which can result in conservative or non-conservative amino acid changes, including additions and deletions. Preferably the nucleotide (and/or resultant amino acid) changes are silent or conserved; that is, they do not alter the characteristics or activity of the NRG1 polypeptide. In one preferred embodiment, the nucleotide sequences are fragments that comprise one or more polymorphic microsatellite markers (e.g., as shown in Tables 2 and 3). In another preferred embodiment, the nucleotide sequences are fragments that comprise one or more single nucleotide polymorphisms in NRG1 (e.g., as shown in Tables 2 and 3).

Other alterations of the nucleic acid molecules of the invention can include, for example, labelling, methylation, internucleotide modifications such as uncharged linkages (e.g., methyl phosphonates, phosphotriesters, phosphoamidates, carbamates), charged linkages (e.g., phosphorothioates, phosphorodithioates), pendent moieties (e.g., polypeptides), intercalators (e.g., acridine, psoralen), chelators, alkylators, and modified linkages (e.g., alpha anomeric nucleic acids). Also included are synthetic molecules that mimic nucleic acid molecules in the ability to bind to a designated sequences via hydrogen bonding and other chemical interactions. Such molecules include, for example, those in which peptide linkages substitute for phosphate linkages in the backbone of the molecule.

The invention also pertains to nucleic acid molecules which hybridize under high stringency hybridization conditions, such as for selective hybridization, to a nucleotide sequence described herein (e.g., nucleic acid molecules which specifically hybridize to a nucleotide sequence encoding polypeptides described herein, and, optionally, have an activity of the polypeptide). In one embodiment, the invention includes variants described herein which hybridize under high stringency hybridization conditions (e.g., for selective hybridization) to a nucleotide sequence comprising a nucleotide sequence selected from SEQ ID NO: 1 or the complement of SEQ ID NO: 1. In another embodiment, the invention includes variants described herein which hybridize under high stringency hybridization conditions (e.g., for selective hybridization) to a nucleotide sequence encoding an amino acid sequence selected from SEQ ID NO: 2-5 and 10-39. In a preferred embodiment, the variant which hybridizes under high stringency hybridizations has an activity of NRG1 (e.g., binding activity).

Such nucleic acid molecules can be detected and/or isolated by specific hybridization (e.g., under high stringency conditions). "Specific hybridization," as used herein, refers to the ability of a first nucleic acid to hybridize to a second nucleic acid in a manner such that the first nucleic acid does not hybridize to any nucleic acid other than to the second nucleic acid (e.g., when the first nucleic acid has a higher similarity to the second nucleic acid than to any other nucleic acid in a sample wherein the hybridization is to be performed). "Stringency conditions" for hybridization is a term of art which refers to the incubation and wash conditions, e.g., conditions of temperature and buffer concentration, which permit hybridization of a particular nucleic acid to a second nucleic acid; the first nucleic acid may be perfectly (i.e., 100%) complementary to the second, or the first and second may share some degree of complementarity which is less than perfect (e.g., 70%, 75%, 85%, 90%, 95%). For example, certain high stringency conditions can be used which distinguish perfectly complementary nucleic acids from those of less complementarity. "High stringency conditions", "moderate stringency conditions" and "low stringency conditions" for nucleic acid hybridizations are explained on pages 2.10.1-2.10.16 and pages 6.3.1-6.3.6 in *Current Protocols in Molecular Biology* (Ausubel, F. M. et al., "*Current Protocols in Molecular Biology*", John Wiley & Sons, (1998), the entire teachings of which are incorporated by reference herein). The exact conditions which determine the stringency of hybridization depend not only on ionic strength (e.g., 0.2×SSC, 0.1×SSC), temperature (e.g., room temperature, 42° C., 68° C.) and the concentration of destabilizing agents such as formamide or denaturing agents such as SDS, but also on factors such as the length of the nucleic acid sequence, base composition, percent mismatch between hybridizing sequences and the frequency of occurrence of subsets of that sequence within other non-identical sequences. Thus, equivalent conditions can be determined by varying one or more of these parameters while maintaining a similar degree of identity or similarity between the two nucleic acid molecules. Typically, conditions are used such that sequences at least about 60%, at least about 70%, at least about 80%, at least about 90% or at least about 95% or more identical to each other remain hybridized to one another. By varying hybridization conditions from a level of stringency at which no hybridization occurs to a level at which hybridization is first observed, conditions which will allow a given sequence to hybridize (e.g., selectively) with the most similar sequences in the sample can be determined.

Exemplary conditions are described in Krause, M. H. and S. A. Aaronson, *Methods in Enzymology,* 200:546-556 (1991). Also, in, Ausubel, et al., "*Current Protocols in Molecular Biology*", John Wiley & Sons, (1998), which describes the determination of washing conditions for moderate or low stringency conditions. Washing is the step in which conditions are usually set so as to determine a minimum level of complementarity of the hybrids. Generally, starting from the lowest temperature at which only homologous hybridization occurs, each ° C. by which the final wash temperature is reduced (holding SSC concentration constant) allows an increase by 1% in the maximum extent of mismatching among the sequences that hybridize. Generally, doubling the concentration of SSC results in an increase in $T_m$ of ~17° C. Using these guidelines, the washing temperature can be determined empirically for high, moderate or low stringency, depending on the level of mismatch sought.

For example, a low stringency wash can comprise washing in a solution containing 0.2×SSC/0.1% SDS for 10 min at room temperature; a moderate stringency wash can comprise washing in a prewarmed solution (42° C.) solution containing 0.2×SSC/0.1% SDS for 15 min at 42° C.; and a high stringency wash can comprise washing in prewarmed (68° C.) solution containing 0.1×SSC/0.1% SDS for 15 min at 68° C. Furthermore, washes can be performed repeatedly or sequentially to obtain a desired result as known in the art. Equivalent conditions can be determined by varying one or more of the parameters given as an example, as known in the art, while maintaining a similar degree of identity or similarity between the target nucleic acid molecule and the primer or probe used.

The percent identity of two nucleotide or amino acid sequences can be determined by aligning the sequences for optimal comparison purposes (e.g., gaps can be introduced in the sequence of a first sequence). The nucleotides or amino acids at corresponding positions are then compared, and the percent identity between the two sequences is a function of the number of identical positions shared by the sequences (i.e., % identity=# of identical positions/total # of positions× 100). In certain embodiments, the length of a sequence aligned for comparison purposes is at least 30%, preferably at least 40%, more preferably at least 60%, and even more preferably at least 70%, 80% or 90% of the length of the reference sequence. The actual comparison of the two sequences can be accomplished by well-known methods, for example, using a mathematical algorithm. A preferred, non-limiting example of such a mathematical algorithm is described in Karlin et al., *Proc. Natl. Acad. Sci. USA*, 90:5873-5877 (1993). Such an algorithm is incorporated into the NBLAST and XBLAST programs (version 2.0) as described in Altschul et al., *Nucleic Acids Res.*, 25:389-3402 (1997). When utilizing BLAST and Gapped BLAST programs, the default parameters of the respective programs (e.g., NBLAST) can be used. In one embodiment, parameters for sequence comparison can be set at score=100, wordlength=12, or can be varied (e.g., W=5 or W=20).

Another preferred, non-limiting example of a mathematical algorithm utilized for the comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art and include ADVANCE and ADAM as described in Torellis and Robotti (1994) *Comput. Appl. Biosci.*, 10:3-5; and FASTA described in Pearson and Lipman (1988) *PNAS*, 85:2444-8.

In another embodiment, the percent identity between two amino acid sequences can be accomplished using the GAP program in the GCG software package (Accelrys, Cambridge, UK) using either a Blossom 63 matrix or a PAM250 matrix, and a gap weight of 12, 10, 8, 6, or 4 and a length weight of 2, 3, or 4. In yet another embodiment, the percent identity between two nucleic acid sequences can be accomplished using the GAP program in the GCG software package, using a gap weight of 50 and a length weight of 3.

The present invention also provides isolated nucleic acid molecules that contain a fragment or portion that hybridizes under highly stringent conditions to a nucleotide sequence comprising a nucleotide sequence selected from SEQ ID NO: 1 and the complement of SEQ ID NO: 1, and also provides isolated nucleic acid molecules that contain a fragment or portion that hybridizes under highly stringent conditions to a nucleotide sequence encoding an amino acid sequence selected from SEQ ID NO: 2-5 and 10-39, inclusive. The nucleic acid fragments of the invention are at least about 15, preferably at least about 18, 20, 23 or 25 nucleotides, and can be 30, 40, 50, 100, 200 or more nucleotides in length. Longer fragments, for example, 30 or more nucleotides in length, which encode antigenic polypeptides described herein are particularly useful, such as for the generation of antibodies as described below.

In a related aspect, the nucleic acid fragments of the invention are used as probes or primers in assays such as those described herein. "Probes" or "primers" are oligonucleotides that hybridize in a base-specific manner to a complementary strand of nucleic acid molecules. Such probes and primers include polypeptide nucleic acids, as described in Nielsen et al., *Science*, 254, 1497-1500 (1991). As also used herein, the term "primer" in particular refers to a single-stranded oligonucleotide which acts as a point of initiation of template-directed DNA synthesis using well-known methods (e.g., PCR, LCR) including, but not limited to those described herein.

Typically, a probe or primer comprises a region of nucleotide sequence that hybridizes to at least about 15, typically about 20-25, and more typically about 40, 50 or 75, consecutive nucleotides of a nucleic acid molecule comprising a contiguous nucleotide sequence selected from: SEQ ID NO: 1, the complement of SEQ ID NO: 1, or a sequence encoding an amino acid sequence selected from SEQ ID NO: 2-5 and 10-39. In preferred embodiments, a probe or primer comprises 100 or fewer nucleotides, preferably from 6 to 50 nucleotides, preferably from 12 to 30 nucleotides. In other embodiments, the probe or primer is at least 70% identical to the contiguous nucleotide sequence or to the complement of the contiguous nucleotide sequence, preferably at least 80% identical, more preferably at least 90% identical, even more preferably at least 95% identical, or even capable of selectively hybridizing to the contiguous nucleotide sequence or to the complement of the contiguous nucleotide sequence. Often, the probe or primer further comprises a label, e.g., radioisotope, fluorescent compound, enzyme, or enzyme cofactor.

Representative oligonucleotides useful as probes or primers include the microsatellite markers shown in Tables 2, 3 and 4.

The nucleic acid molecules of the invention such as those described above can be identified and isolated using standard molecular biology techniques and the sequence information provided in SEQ ID NO: 1, and/or 2-5 and 10-39. For example, nucleic acid molecules can be amplified and isolated by the polymerase chain reaction using synthetic oligonucleotide primers designed based on one or more of the sequences provided in SEQ ID NO: 1 and/or the complement of SEQ ID NO: 1, or designed based on nucleotides based on sequences encoding one or more of the amino acid sequences provided in any one or more of SEQ ID NO: 2-5 and 10-39. See generally *PCR Technology: Principles and Applications for DNA Amplification* (ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.*, 19:4967 (1991); Eckert et al., *PCR Methods and Applications*, 1:17 (1991); PCR (eds. McPherson et al., IRL Press, Oxford); and U.S. Pat. No. 4,683,202. The nucleic acid molecules can be amplified using cDNA, mRNA or genomic DNA as a template, cloned into an appropriate vector and characterized by DNA sequence analysis.

Other suitable amplification methods include the ligase chain reaction (LCR) (see Wu and Wallace, *Genomics*, 4:560 (1989), Landegren et al., *Science*, 241:1077 (1988), transcription amplification (Kwoh et al., *Proc. Natl. Acad. Sci. USA*, 86:1173 (1989)), and self-sustained sequence replication (Guatelli et al., *Proc. Nat. Acad. Sci. USA*, 87:1874 (1990)) and nucleic acid based sequence amplification (NASBA). The latter two amplification methods involve isothermal reactions based on isothermal transcription, which produce both single stranded RNA (ssRNA) and double stranded DNA (dsDNA) as the amplification products in a ratio of about 30 or 100 to 1, respectively.

The amplified DNA can be radiolabelled and used as a probe for screening a cDNA library derived from human cells, mRNA in zap express, ZIPLOX or other suitable vector. Corresponding clones can be isolated, DNA can obtained following in vivo excision, and the cloned insert can be sequenced in either or both orientations by art recognized methods to identify the correct reading frame encoding a polypeptide of the appropriate molecular weight. For example, the direct analysis of the nucleotide sequence of nucleic acid molecules of the present invention can be accomplished using well-known methods that are commercially available. See, for example, Sambrook et al., *Molecular Cloning, A Laboratory Manual* (2nd Ed., CSHP, New York 1989); Zyskind et al., *Recombinant DNA Laboratory Manual*, (Acad. Press, 1988). Using these or similar methods, the polypeptide and the DNA encoding the polypeptide can be isolated, sequenced and further characterized.

Antisense nucleic acid molecules of the invention can be designed using the nucleotide sequences of SEQ ID NO: 1 and/or the complement of SEQ ID NO: 1, and/or a portion of SEQ ID NO: 1 or the complement of SEQ ID NO: 1, and/or a sequence encoding the amino acid sequence of any one or more of SEQ ID NO: 2-5 or 10-39, or encoding a portion of any one or more of SEQ ID NO: 2-5 or 10-39, and constructed using chemical synthesis and enzymatic ligation reactions using procedures known in the art. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Alternatively, the antisense nucleic acid molecule can be produced biologically using an expression vector into which a nucleic acid molecule has been subcloned in an antisense orientation (i.e., RNA transcribed from the inserted nucleic acid molecule will be of an antisense orientation to a target nucleic acid of interest).

In general, the isolated nucleic acid sequences of the invention can be used as molecular weight markers on Southern gels, and as chromosome markers which are labeled to map related gene positions. The nucleic acid sequences can also be used to compare with endogenous DNA sequences in patients to identify genetic disorders (e.g., a predisposition for or susceptibility to schizophrenia), and as probes, such as to hybridize and discover related DNA sequences or to subtract out known sequences from a sample. The nucleic acid sequences can further be used to derive primers for genetic fingerprinting, to raise anti-polypeptide antibodies using DNA immunization techniques, and as an antigen to raise anti-DNA antibodies or elicit immune responses. Portions or fragments of the nucleotide sequences identified herein (and the corresponding complete gene sequences) can be used in numerous ways as polynucleotide reagents. For example, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. Additionally, the nucleotide sequences of the invention can be used to identify and express recombinant polypeptides for analysis, characterization or therapeutic use, or as markers for tissues in which the corresponding polypeptide is expressed, either constitutively, during tissue differentiation, or in diseased states. The nucleic acid sequences can additionally be used as reagents in the screening and/or diagnostic assays described herein, and can also be included as components of kits (e.g., reagent kits) for use in the screening and/or diagnostic assays described herein.

Another aspect of the invention pertains to nucleic acid constructs containing a nucleic acid molecule selected from the group consisting of SEQ ID NO: 1 and the complement of SEQ ID NO: 1 (or a portion thereof). Yet another aspect of the invention pertains to nucleic acid constructs containing a nucleic acid molecule encoding the amino acid sequence of any one of SEQ ID NO: 2-5 or 10-39. The constructs comprise a vector (e.g., an expression vector) into which a sequence of the invention has been inserted in a sense or antisense orientation. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, expression vectors, are capable of directing the expression of genes to which they are operably linked. In general, expression vectors of utility in recombinant DNA techniques are often in the form of plasmids. However, the invention is intended to include such other forms of expression vectors, such as viral vectors (e.g., replication defective retroviruses, adenoviruses and adeno-associated viruses) that serve equivalent functions.

Preferred recombinant expression vectors of the invention comprise a nucleic acid molecule of the invention in a form suitable for expression of the nucleic acid molecule in a host cell. This means that the recombinant expression vectors include one or more regulatory sequences, selected on the basis of the host cells to be used for expression, which is operably linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed and the level of expression of polypeptide desired. The expression vectors of the invention can be introduced into host cells to thereby produce polypeptides, including fusion polypeptides, encoded by nucleic acid molecules as described herein.

The recombinant expression vectors of the invention can be designed for expression of a polypeptide of the invention in prokaryotic or eukaryotic cells, e.g., bacterial cells such as *E. coli*, insect cells (using baculovirus expression vectors), yeast cells or mammalian cells. Suitable host cells are discussed further in Goeddel, supra. Alternatively, the recombinant expression vector can be transcribed and translated in vitro, for example using T7 promoter regulatory sequences and T7 polymerase.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, a nucleic acid molecule of the invention can be expressed in bacterial cells (e.g., *E. coli*), insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing a foreign nucleic acid molecule (e.g., DNA) into a host cell, including calcium phosphate or calcium chloride co-precipitation, DEAE-dextran-mediated transfection, lipofection, or electroporation.

Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those that confer resistance to drugs, such as G418, hygromycin and methotrexate. Nucleic acid molecules encoding a selectable marker can be introduced into a host cell on the same vector as the nucleic acid molecule of the invention or can be introduced on a separate vector. Cells stably transfected with the introduced nucleic acid molecule can be identified by drug selection (e.g., cells that have incorporated the selectable marker gene will survive, while the other cells die).

A host cell of the invention, such as a prokaryotic or eukaryotic host cell in culture, can be used to produce (i.e., express) a polypeptide of the invention. Accordingly, the invention further provides methods for producing a polypeptide using the host cells of the invention. In one embodiment, the method comprises culturing the host cell of invention (into which a recombinant expression vector encoding a polypeptide of the invention has been introduced) in a suitable medium such that the polypeptide is produced. In another embodiment, the method further comprises isolating the polypeptide from the medium or the host cell.

The host cells of the invention can also be used to produce nonhuman transgenic animals. For example, in one embodiment, a host cell of the invention is a fertilized oocyte or an embryonic stem cell into which a nucleic acid molecule of the invention (e.g, an exogenous neuregulin 1 gene, or an exogenous nucleic acid encoding an NRG1 polypeptide) has been introduced. Such host cells can then be used to create non-human transgenic animals in which exogenous nucleotide sequences have been introduced into the genome or homologous recombinant animals in which endogenous nucleotide sequences have been altered. Such animals are useful for studying the function and/or activity of the nucleotide sequence and polypeptide encoded by the sequence and for identifying and/or evaluating modulators of their activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens and amphibians. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, an "homologous recombinant animal" is a non-human animal, preferably a mammal, more preferably a mouse, in which an endogenous gene has been altered by homologous recombination between the endogenous gene and an exogenous DNA molecule introduced into a cell of the animal, e.g., an embryonic cell of the animal, prior to development of the animal.

Methods for generating transgenic animals via embryo manipulation and microinjection, particularly animals such as mice, have become conventional in the art and are described, for example, in U.S. Pat. Nos. 4,736,866 and 4,870,009, U.S. Pat. No. 4,873,191 and in Hogan, *Manipulating the Mouse Embryo* (Cold Spring Harbor Laboratory Press, Cold Spring Harbor, N.Y., 1986). Methods for constructing homologous recombination vectors and homologous recombinant animals are described further in Bradley (1991) *Current Opinion in Bio/Technology*, 2:823-829 and in PCT Publication Nos. WO 90/11354, WO 91/01140, WO 92/0968, and WO 93/04169. Clones of the non-human transgenic animals described herein can also be produced according to the methods described in Wilmut et al. (1997) *Nature*, 385:810-813 and PCT Publication Nos. WO 97/07668 and WO 97/07669.

Polypeptides of the Invention

The present invention also pertains to isolated polypeptides encoded by NRG1 ("NRG1 polypeptides"), and fragments and variants thereof, as well as polypeptides encoded by nucleotide sequences described herein (e.g., other splicing variants). The term "polypeptide" refers to a polymer of amino acids, and not to a specific length; thus, peptides, oligopeptides and proteins are included within the definition of a polypeptide. As used herein, a polypeptide is said to be "isolated" or "purified" when it is substantially free of cellular material when it is isolated from recombinant and non-recombinant cells, or free of chemical precursors or other chemicals when it is chemically synthesized. A polypeptide, however, can be joined to another polypeptide with which it is not normally associated in a cell (e.g., in a "fusion protein") and still be "isolated" or "purified."

The polypeptides of the invention can be purified to homogeneity. It is understood, however, that preparations in which the polypeptide is not purified to homogeneity are useful. The critical feature is that the preparation allows for the desired function of the polypeptide, even in the presence of considerable amounts of other components. Thus, the invention encompasses various degrees of purity. In one embodiment, the language "substantially free of cellular material" includes preparations of the polypeptide having less than about 30% (by dry weight) other proteins (i.e., contaminating protein), less than about 20% other proteins, less than about 10% other proteins, or less than about 5% other proteins.

When a polypeptide is recombinantly produced, it can also be substantially free of culture medium, i.e., culture medium represents less than about 20%, less than about 10%, or less than about 5% of the volume of the polypeptide preparation. The language "substantially free of chemical precursors or other chemicals" includes preparations of the polypeptide in which it is separated from chemical precursors or other chemicals that are involved in its synthesis. In one embodiment, the language "substantially free of chemical precursors or other chemicals" includes preparations of the polypeptide having less than about 30% (by dry weight) chemical precursors or other chemicals, less than about 20% chemical precursors or other chemicals, less than about 10% chemical precursors or other chemicals, or less than about 5% chemical precursors or other chemicals.

In one embodiment, a polypeptide of the invention comprises an amino acid sequence encoded by a nucleic acid molecule comprising a nucleotide sequence selected from the group consisting of SEQ ID NO: 1 and complements and portions thereof, e.g., any one of SEQ ID NO: 2-5 or 10-39, or a portion of any one of SEQ ID NO: 2-5 or 10-39.

The polypeptides of the invention also encompass fragments and sequence variants. Variants include a substantially homologous polypeptide encoded by the same genetic locus in an organism, i.e., an allelic variant, as well as other splicing variants. Variants also encompass polypeptides derived from other genetic loci in an organism, but having substantial homology to a polypeptide encoded by a nucleic acid molecule comprising a nucleotide sequence selected from the group consisting of SEQ ID NO: 1 and complements and portions thereof, or having substantial homology to a polypeptide encoded by a nucleic acid molecule comprising a nucleotide sequence selected from the group consisting of nucleotide sequences encoding any one of SEQ ID NO: 2-5 or 10-39. Variants also include polypeptides substantially homologous or identical to these polypeptides but derived from another organism, i.e., an ortholog. Variants also include polypeptides that are substantially homologous or identical to these polypeptides that are produced by chemical synthesis. Variants also include polypeptides that are substantially homologous or identical to these polypeptides that are produced by recombinant methods.

As used herein, two polypeptides (or a region of the polypeptides) are substantially homologous or identical when the amino acid sequences are at least about 45-55%, typically at least about 70-75%, more typically at least about 80-85%, and most typically greater than about 90% or more homologous or identical. A substantially homologous amino acid sequence, according to the present invention, will be encoded by a nucleic acid molecule hybridizing to SEQ ID NO: 1, or portion thereof, under stringent conditions as more particularly described above, or will be encoded by a nucleic acid molecule hybridizing to a nucleic acid sequence encoding any one of SEQ ID NO: 2-5 or 10-39, or portion thereof, under stringent conditions as more particularly described thereof.

To determine the percent homology or identity of two amino acid sequences, or of two nucleic acid sequences, the sequences are aligned for optimal comparison purposes (e.g., gaps can be introduced in the sequence of one polypeptide or nucleic acid molecule for optimal alignment with the other polypeptide or nucleic acid molecule). The amino acid residues or nucleotides at corresponding amino acid positions or nucleotide positions are then compared. When a position in one sequence is occupied by the same amino acid residue or nucleotide as the corresponding position in the other sequence, then the molecules are homologous at that position. As used herein, amino acid or nucleic acid "homology" is equivalent to amino acid or nucleic acid "identity". The percent homology between the two sequences is a function of the number of identical positions shared by the sequences (i.e., percent homology equals the number of identical positions/ total number of positions times 100).

The invention also encompasses polypeptides having a lower degree of identity but having sufficient similarity so as to perform one or more of the same functions performed by a polypeptide encoded by a nucleic acid molecule of the invention. Similarity is determined by conserved amino acid substitution. Such substitutions are those that substitute a given amino acid in a polypeptide by another amino acid of like characteristics. Conservative substitutions are likely to be phenotypically silent. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe and Tyr. Guidance concerning which amino acid changes are likely to be phenotypically silent are found in Bowie et al., Science 247:1306-1310 (1990).

A variant polypeptide can differ in amino acid sequence by one or more substitutions, deletions, insertions, inversions, fusions, and truncations or a combination of any of these. Further, variant polypeptides can be fully functional or can lack function in one or more activities. Fully functional variants typically contain only conservative variation or variation in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, or truncation or a substitution, insertion, inversion, or deletion in a critical residue or critical region.

Amino acids that are essential for function can be identified by methods known in the art, such as site-directed mutagenesis or alanine-scanning mutagenesis (Cunningham et al., *Science*, 244:1081-1085 (1989)). The latter procedure introduces single alanine mutations at every residue in the molecule. The resulting mutant molecules are then tested for biological activity in vitro, or in vitro proliferative activity. Sites that are critical for polypeptide activity can also be determined by structural analysis such as crystallization, nuclear magnetic resonance or photoaffinity labeling (Smith et al., *J. Mol. Biol.*, 224:899-904 (1992); de Vos et al. *Science*, 255:306-312 (1992)).

The invention also includes polypeptide fragments of the polypeptides of the invention. Fragments can be derived from a polypeptide encoded by a nucleic acid molecule comprising SEQ ID NO: 1 or a portion thereof and the complements thereof (e.g., SEQ ID NO: 2-5 or 10-39, or other splicing variants). However, the invention also encompasses fragments of the variants of the polypeptides described herein. As used herein, a fragment comprises at least 6 contiguous amino acids. Useful fragments include those that retain one or more of the biological activities of the polypeptide as well as fragments that can be used as an immunogen to generate polypeptide-specific antibodies.

Biologically active fragments (peptides which are, for example, 6, 9, 12, 15, 16, 20, 30, 35, 36, 37, 38, 39, 40, 50, 100 or more amino acids in length) can comprise a domain, segment, or motif that has been identified by analysis of the polypeptide sequence using well-known methods, e.g., signal peptides, extracellular domains, one or more transmembrane segments or loops, ligand binding regions, zinc finger domains, DNA binding domains, acylation sites, glycosylation sites, or phosphorylation sites. Enzymatically active fragments can comprise a domain, segment, or motif that has been identified by analysis of an enzyme using well-known methods, as described above. Such biologically active fragments or enzymatically active fragments can be identified using standard means for asssaying activity of a polypeptide or enzyme.

Fragments can be discrete (not fused to other amino acids or polypeptides) or can be within a larger polypeptide. Further, several fragments can be comprised within a single larger polypeptide. In one embodiment a fragment designed for expression in a host can have heterologous pre- and propolypeptide regions fused to the amino terminus of the polypeptide fragment and an additional region fused to the carboxyl terminus of the fragment.

The invention thus provides chimeric or fusion polypeptides. These comprise a polypeptide of the invention operatively linked to a heterologous protein or polypeptide having an amino acid sequence not substantially homologous to the polypeptide. "Operatively linked" indicates that the polypeptide and the heterologous protein are fused in-frame. The heterologous protein can be fused to the N-terminus or C-terminus of the polypeptide. In one embodiment the fusion polypeptide does not affect function of the polypeptide per se.

For example, the fusion polypeptide can be a GST-fusion polypeptide in which the polypeptide sequences are fused to the C-terminus of the GST sequences. Other types of fusion polypeptides include, but are not limited to, enzymatic fusion polypeptides, for example β-galactosidase fusions, yeast two-hybrid GAL fusions, poly-His fusions and Ig fusions. Such fusion polypeptides, particularly poly-His fusions, can facilitate the purification of recombinant polypeptide. In certain host cells (e.g., mammalian host cells), expression and/or secretion of a polypeptide can be increased by using a heterologous signal sequence. Therefore, in another embodiment, the fusion polypeptide contains a heterologous signal sequence at its N-terminus.

EP-A-O 464 533 discloses fusion proteins comprising various portions of immunoglobulin constant regions. The Fc is useful in therapy and diagnosis and thus results, for example, in improved pharmacokinetic properties (EP-A 0232 262). In drug discovery, for example, human proteins have been fused with Fc portions for the purpose of high-throughput screening assays to identify antagonists. Bennett et al., Journal of Molecular Recognition, 8:52-58 (1995) and Johanson et al., The Journal of Biological Chemistry, 270, 16:9459-9471 (1995). Thus, this invention also encompasses soluble fusion polypeptides containing a polypeptide of the invention and various portions of the constant regions of heavy or light chains of immunoglobulins of various subclass (IgG, IgM, IgA, IgE).

A chimeric or fusion polypeptide can be produced by standard recombinant DNA techniques. For example, DNA fragments coding for the different polypeptide sequences are ligated together in-frame in accordance with conventional techniques. In another embodiment, the fusion gene can be synthesized by conventional techniques including automated DNA synthesizers. Alternatively, PCR amplification of nucleic acid fragments can be carried out using anchor primers which give rise to complementary overhangs between two consecutive nucleic acid fragments which can subsequently be annealed and re-amplified to generate a chimeric nucleic acid sequence (see Ausubel et al., *Current Protocols in Molecular Biology*, 1992). Moreover, many expression vectors are commercially available that already encode a fusion moiety (e.g., a GST protein). A nucleic acid molecule encoding a polypeptide of the invention can be cloned into such an expression vector such that the fusion moiety is linked in-frame to the polypeptide.

The isolated polypeptide can be purified from cells that naturally express it, purified from cells that have been altered to express it (recombinant), or synthesized using known protein synthesis methods. In one embodiment, the polypeptide is produced by recombinant DNA techniques. For example, a nucleic acid molecule encoding the polypeptide is cloned into an expression vector, the expression vector introduced into a host cell and the polypeptide expressed in the host cell. The polypeptide can then be isolated from the cells by an appropriate purification scheme using standard protein purification techniques.

In general, polypeptides of the present invention can be used as a molecular weight marker on SDS-PAGE gels or on molecular sieve gel filtration columns using art-recognized methods. The polypeptides of the present invention can be used to raise antibodies or to elicit an immune response. The polypeptides can also be used as a reagent, e.g., a labeled reagent, in assays to quantitatively determine levels of the polypeptide or a molecule to which it binds (e.g., a receptor or a ligand) in biological fluids. The polypeptides can also be used as markers for cells or tissues in which the corresponding polypeptide is preferentially expressed, either constitutively, during tissue differentiation, or in a diseased state. The polypeptides can be used to isolate a corresponding binding agent, e.g., receptor or ligand, such as, for example, in an interaction trap assay, and to screen for peptide or small molecule antagonists or agonists of the binding interaction. For example, because neuregulin 1 binds and activates ErbB receptor tyrosine kinases, the polypeptides can be used to isolate such ErbB receptor kinases.

Antibodies of the Invention

In another aspect, the invention provides antibodies to the polypeptides and polypeptide fragments of the invention, e.g., having an amino acid sequence encoded by any one of SEQ ID NO:2-5 or 10-39, or a portion thereof, or having an amino acid sequence encoded by a nucleic acid molecule comprising all or a portion of SEQ ID NO: 1 (e.g., SEQ ID NO: 2-5 or 10-39, or another splicing variant, or portion thereof). The term "antibody" as used herein refers to immunoglobulin molecules and immunologically active portions of immunoglobulin molecules, i.e., molecules that contain an antigen binding site that specifically binds an antigen. A molecule that specifically binds to a polypeptide of the invention is a molecule that binds to that polypeptide or a fragment thereof, but does not substantially bind other molecules in a sample, e.g., a biological sample, which naturally contains the polypeptide. Examples of immunologically active portions of immunoglobulin molecules include F(ab) and F(ab')$_2$ fragments which can be generated by treating the antibody with an enzyme such as pepsin. The invention provides polyclonal and monoclonal antibodies that bind to a polypeptide of the invention. The term "monoclonal antibody" or "monoclonal antibody composition", as used herein, refers to a population of antibody molecules that contain only one species of an antigen binding site capable of immunoreacting with a particular epitope of a polypeptide of the invention. A monoclonal antibody composition thus typically displays a single binding affinity for a particular polypeptide of the invention with which it immunoreacts.

Polyclonal antibodies can be prepared as described above by immunizing a suitable subject with a desired immunogen, e.g., polypeptide of the invention or fragment thereof. The antibody titer in the immunized subject can be monitored over time by standard techniques, such as with an enzyme linked immunosorbent assay (ELISA) using immobilized polypeptide. If desired, the antibody molecules directed against the polypeptide can be isolated from the mammal (e.g., from the blood) and further purified by well-known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybridoma technique originally described by Kohler and Milstein (1975) *Nature*, 256:495-497, the human B cell hybridoma technique (Kozbor et al. (1983) *Immunol. Today*, 4:72), the EBV-hybridoma technique (Cole et al. (1985), *Monoclonal Antibodies and Cancer Therapy*, Alan R. Liss, Inc., pp. 77-96) or trioma techniques. The technology for producing hybridomas is well known (see generally *Current Protocols in Immunology* (1994) Coligan et al. (eds.) John Wiley & Sons, Inc., New York, N.Y.). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds a polypeptide of the invention.

Any of the many well known protocols used for fusing lymphocytes and immortalized cell lines can be applied for the purpose of generating a monoclonal antibody to a polypeptide of the invention (see, e.g., *Current Protocols in Immunology*, supra; Galfre et al. (1977) *Nature*, 266:55052; R. H. Kenneth, in *Monoclonal Antibodies: A New Dimension In Biological Analyses*, Plenum Publishing Corp., New York, N.Y. (1980); and Lerner (1981) *Yale J. Biol. Med.*, 54:387-402. Moreover, the ordinarily skilled worker will appreciate that there are many variations of such methods that also would be useful.

Alternative to preparing monoclonal antibody-secreting hybridomas, a monoclonal antibody to a polypeptide of the invention can be identified and isolated by screening a recombinant combinatorial immunoglobulin library (e.g., an antibody phage display library) with the polypeptide to thereby isolate immunoglobulin library members that bind the polypeptide. Kits for generating and screening phage display libraries are commercially available (e.g., the *Pharmacia Recombinant Phage Antibody System*, Catalog No. 27-9400-01; and the Stratagene SurfZAP™ Phage Display Kit, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) *Bio/Technology*, 9:1370-1372; Hay et al. (1992) *Hum. Antibod. Hybridomas*, 3:81-85; Huse et al. (1989) *Science*, 246:1275-1281; Griffiths et al. (1993) *EMBO J.*, 12:725-734.

Additionally, recombinant antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art. Human antibodies are also contemplated and can be produced and used with techniques known in the art.

In general, antibodies of the invention (e.g., a monoclonal antibody) can be used to isolate a polypeptide of the invention by standard techniques, such as affinity chromatography or immunoprecipitation. A polypeptide-specific antibody can facilitate the purification of natural polypeptide from cells and of recombinantly produced polypeptide expressed in host cells. Moreover, an antibody specific for a polypeptide of the invention can be used to detect the polypeptide (e.g., in a cellular lysate, cell supernatant, or tissue sample) in order to evaluate the abundance and pattern of expression of the polypeptide. Antibodies can be used diagnostically to monitor protein levels in tissue as part of a clinical testing procedure, e.g., to, for example, determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include 125I, 131I, 35S or 3H.

Diagnostic and Screening Assays of the Invention

The present invention also pertains to diagnostic assays for assessing neuregulin 1 gene expression, or for assessing activity of NRG1 polypeptides of the invention. In one embodiment, the assays are used in the context of a biological sample (e.g., blood, serum, cells, tissue) to thereby determine whether an individual is afflicted with schizophrenia, or is at risk for (has a predisposition for or a susceptibility to) developing schizophrenia. The invention also provides for prognostic (or predictive) assays for determining whether an individual is susceptible to developing schizophrenia. For example, mutations in the gene can be assayed in a biological sample. Such assays can be used for prognostic or predictive purpose to thereby prophylactically treat an individual prior to the onset of symptoms associated with schizophrenia. Another aspect of the invention pertains to assays for monitoring the influence of agents (e.g., drugs, compounds or other agents) on the gene expression or activity of polypeptides of the invention, as well as to assays for identifying agents which bind to NRG1 polypeptides. These and other assays and agents are described in further detail in the following sections.

Diagnostic Assays

The nucleic acids, probes, primers, polypeptides and antibodies described herein can be used in methods of diagnosis of a susceptibility to schizophrenia, as well as in kits useful for diagnosis of a susceptibility to schizophrenia.

In one embodiment of the invention, diagnosis of a susceptibility to schizophrenia is made by detecting a polymorphism in NRG1. The polymorphism can be a mutation in NRG1, such as the insertion or deletion of a single nucleotide, or of more than one nucleotide, resulting in a frame shift mutation; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of the gene; duplication of all or a part of the gene; transposition of all or a part of the gene; or rearrangement of all or a part of the gene. More than one such mutation may be present in a single gene. Such sequence changes cause a mutation in the polypeptide encoded by NRG1. For example, if the mutation is a frame shift mutation, the frame shift can result in a change in the encoded amino acids, and/or can result in the generation of a premature stop codon, causing generation of a truncated polypeptide. Alternatively, a polymorphism associated with a susceptibility to schizophrenia can be a synonymous mutation in one or more nucleotides (i.e., a mutation that does not result in a change in the polypeptide encoded by NRG1). Such a polymorphism may alter splicing sites, affect the stability or transport of mRNA, or otherwise affect the transcription or translation of the gene. NRG1 that has any of the mutations described above is referred to herein as a "mutant gene."

In a first method of diagnosing a susceptibility to schizophrenia, hybridization methods, such as Southern analysis, Northern analysis, or in situ hybridizations, can be used (see *Current Protocols in Molecular Biology*, Ausubel, F. et al., eds., John Wiley & Sons, including all supplements). For example, a biological sample from a test subject (a "test sample") of genomic DNA, RNA, or cDNA, is obtained from an individual suspected of having, being susceptible to or predisposed for, or carrying a defect for, schizophrenia (the "test individual"). The individual can be an adult, child, or fetus. The test sample can be from any source which contains genomic DNA, such as a blood sample, sample of amniotic fluid, sample of cerebrospinal fluid, or tissue sample from skin, muscle, buccal or conjunctival mucosa, placenta, gastrointestinal tract or other organs. A test sample of DNA from fetal cells or tissue can be obtained by appropriate methods, such as by amniocentesis or chorionic villus sampling. The DNA, RNA, or cDNA sample is then examined to determine whether a polymorphism in NRG1 is present, and/or to determine which splicing variant(s) encoded by NRG1 is present. The presence of the polymorphism or splicing variant(s) can be indicated by hybridization of the gene in the genomic DNA, RNA, or cDNA to a nucleic acid probe. A "nucleic acid probe", as used herein, can be a DNA probe or an RNA probe; the nucleic acid probe can contain at least one polymorphism in NRG1 or contains a nucleic acid encoding a particular splicing variant of NRG1. The probe can be any of the nucleic acid molecules described above (e.g., the gene, a fragment, a vector comprising the gene, a probe or primer, etc.)

To diagnose a susceptibility to schizophrenia, a hybridization sample is formed by contacting the test sample containing NRG1, with at least one nucleic acid probe. A preferred probe for detecting mRNA or genomic DNA is a labeled nucleic acid probe capable of hybridizing to mRNA or genomic DNA sequences described herein. The nucleic acid probe can be, for example, a full-length nucleic acid molecule, or a portion thereof, such as an oligonucleotide of at least 15, 30, 50, 100, 250 or 500 nucleotides in length and sufficient to specifically hybridize under stringent conditions to appropriate mRNA or genomic DNA. For example, the nucleic acid probe can be all or a portion of SEQ ID NO: 1, or the complement of SEQ ID NO: 1, or a portion thereof; or can be a nucleic acid encoding all or a portion of any one (or more) of SEQ ID NO: 2-5 or 10-39. Other suitable probes for use in the diagnostic assays of the invention are described above (see. e.g., probes and primers discussed under the heading, "Nucleic Acids of the Invention").

The hybridization sample is maintained under conditions which are sufficient to allow specific hybridization of the nucleic acid probe to NRG1. "Specific hybridization", as used herein, indicates exact hybridization (e.g., with no mismatches). Specific hybridization can be performed under high stringency conditions or moderate stringency conditions, for example, as described above. In a particularly preferred embodiment, the hybridization conditions for specific hybridization are high stringency.

Specific hybridization, if present, is then detected using standard methods. If specific hybridization occurs between the nucleic acid probe and NRG1 in the test sample, then NRG1 has the polymorphism, or is the splicing variant, that is present in the nucleic acid probe. More than one nucleic acid probe can also be used concurrently in this method. Specific hybridization of any one of the nucleic acid probes is indicative of a polymorphism in NRG1, or of the presence of a particular splicing variant encoded by NRG1, and is therefore diagnostic for a susceptibility to schizophrenia.

In Northern analysis (see Current Protocols in Molecular Biology, Ausubel, F. et al., eds., John Wiley & Sons, supra), the hybridization methods described above are used to identify the presence of a polymorphism or of a particular splicing variant, associated with a susceptibility to schizophrenia. For Northern analysis, a test sample of RNA is obtained from the individual by appropriate means. Specific hybridization of a nucleic acid probe, as described above, to RNA from the individual is indicative of a polymorphism in NRG1, or of the presence of a particular splicing variant encoded by NRG1, and is therefore diagnostic for a susceptibility to schizophrenia.

For representative examples of use of nucleic acid probes, see, for example, U.S. Pat. Nos. 5,288,611 and 4,851,330.

Alternatively, a peptide nucleic acid (PNA) probe can be used instead of a nucleic acid probe in the hybridization methods described above. PNA is a DNA mimic having a peptide-like, inorganic backbone, such as N-(2-aminoethyl) glycine units, with an organic base (A, G, C, T or U) attached to the glycine nitrogen via a methylene carbonyl linker (see, for example, Nielsen, P. E. et al., *Bioconjugate Chemistry*, 1994, 5, American Chemical Society, p. 1 (1994). The PNA probe can be designed to specifically hybridize to a gene having a polymorphism associated with a susceptibility to schizophrenia. Hybridization of the PNA probe to NRG1 is diagnostic for a susceptibility to schizophrenia.

In another method of the invention, mutation analysis by restriction digestion can be used to detect a mutant gene, or genes containing a polymorphism(s), if the mutation or polymorphism in the gene results in the creation or elimination of a restriction site. A test sample containing genomic DNA is obtained from the individual. Polymerase chain reaction (PCR) can be used to amplify NRG1 (and, if necessary, the flanking sequences) in the test sample of genomic DNA from the test individual. RFLP analysis is conducted as described (see Current Protocols in Molecular Biology, supra). The digestion pattern of the relevant DNA fragment indicates the presence or absence of the mutation or polymorphism in NRG1, and therefore indicates the presence or absence of this susceptibility to schizophrenia.

Sequence analysis can also be used to detect specific polymorphisms in NRG1. A test sample of DNA or RNA is obtained from the test individual. PCR or other appropriate methods can be used to amplify the gene, and/or its flanking sequences, if desired. The sequence of NRG1, or a fragment of the gene, or cDNA, or fragment of the cDNA, or mRNA, or fragment of the mRNA, is determined, using standard methods. The sequence of the gene, gene fragment, cDNA, cDNA fragment, mRNA, or mRNA fragment is compared with the known nucleic acid sequence of the gene, cDNA (e.g., SEQ ID NO: 1, or a nucleic acid sequence encoding any one (or more) of SEQ ID NO: 2-5 or 10-39, or a fragment thereof) or mRNA, as appropriate. The presence of a polymorphism in NRG1 indicates that the individual has a susceptibility to schizophrenia.

Allele-specific oligonucleotides can also be used to detect the presence of a polymorphism in NRG1, through the use of dot-blot hybridization of amplified oligonucleotides with allele-specific oligonucleotide (ASO) probes (see, for example, Saiki, R. et al., (1986), *Nature* (London) 324:163-166). An "allele-specific oligonucleotide" (also referred to herein as an "allele-specific oligonucleotide probe") is an oligonucleotide of approximately 10-50 base pairs, preferably approximately 15-30 base pairs, that specifically hybridizes to NRG1, and that contains a polymorphism associated with a susceptibility to schizophrenia. An allele-specific oligonucleotide probe that is specific for particular polymorphisms in NRG1 can be prepared, using standard methods (see Current Protocols in Molecular Biology, supra). To identify polymorphisms in the gene that are associated with a susceptibility to schizophrenia, a test sample of DNA is obtained from the individual. PCR can be used to amplify all or a fragment of NRG1, and its flanking sequences. The DNA containing the amplified NRG1 (or fragment of the gene) is dot-blotted, using standard methods (see Current Protocols in Molecular Biology, supra), and the blot is contacted with the oligonucleotide probe. The presence of specific hybridization of the probe to the amplified NRG1 is then detected. Specific hybridization of an allele-specific oligonucleotide probe to DNA from the individual is indicative of a polymorphism in NRG1, and is therefore indicative of a susceptibility to schizophrenia.

In another embodiment, arrays of oligonucleotide probes that are complementary to target nucleic acid sequence segments from an individual, can be used to identify polymorphisms in NRG1. For example, in one embodiment, an oligonucleotide array can be used. Oligonucleotide arrays typically comprise a plurality of different oligonucleotide probes that are coupled to a surface of a substrate in different known locations. These oligonucleotide arrays, also described as "Genechips™," have been generally described in the art, for example, U.S. Pat. No. 5,143,854 and PCT patent publication Nos. WO 90/15070 and 92/10092. These arrays can generally be produced using mechanical synthesis methods or light directed synthesis methods which incorporate a combination of photolithographic methods and solid phase oligonucleotide synthesis methods. See Fodor et al., Science, 251:767-777 (1991), Pirrung et al., U.S. Pat. No. 5,143,854 (see also PCT Application No. WO 90/15070) and Fodor et al., PCT Publication No. WO 92/10092 and U.S. Pat. No. 5,424,186, the entire teachings of each of which are incorporated by reference herein. Techniques for the synthesis of these arrays using mechanical synthesis methods are described in, e.g., U.S. Pat. No. 5,384,261, the entire teachings of which are incorporated by reference herein.

Once an oligonucleotide array is prepared, a nucleic acid of interest is hybridized with the array and scanned for polymorphisms. Hybridization and scanning are generally carried out by methods described herein and also in, e.g., Published PCT Application Nos. WO 92/10092 and WO 95/11995, and U.S. Pat. No. 5,424,186, the entire teachings of which are incorporated by reference herein. In brief, a target nucleic acid sequence which includes one or more previously identified polymorphic markers is amplified by well known amplification techniques, e.g., PCR. Typically, this involves the use of primer sequences that are complementary to the two strands of the target sequence both upstream and downstream from the polymorphism. Asymmetric PCR techniques may also be used. Amplified target, generally incorporating a label, is then hybridized with the array under appropriate conditions. Upon completion of hybridization and washing of the array, the array is scanned to determine the position on the array to which the target sequence hybridizes. The hybridization data obtained from the scan is typically in the form of fluorescence intensities as a function of location on the array.

Although primarily described in terms of a single detection block, e.g., for detection of a single polymorphism, arrays can include multiple detection blocks, and thus be capable of analyzing multiple, specific polymorphisms. In alternate arrangements, it will generally be understood that detection blocks may be grouped within a single array or in multiple, separate arrays so that varying, optimal conditions may be used during the hybridization of the target to the array. For example, it may often be desirable to provide for the detection of those polymorphisms that fall within G-C rich stretches of a genomic sequence, separately from those falling in A-T rich segments. This allows for the separate optimization of hybridization conditions for each situation.

Additional description of use of oligonucleotide arrays for detection of polymorphisms can be found, for example, in U.S. Pat. Nos. 5,858,659 and 5,837,832, the entire teachings of which are incorporated by reference herein.

Other methods of nucleic acid analysis can be used to detect polymorphisms in NRG1 or splicing variants encoded by NRG1. Representative methods include direct manual sequencing (Church and Gilbert, (1988), *Proc. Natl. Acad. Sci. USA* 81:1991-1995; Sanger, F. et al. (1977) *Proc. Natl. Acad. Sci.* 74:5463-5467; Beavis et al. U.S. Pat. No. 5,288,644); automated fluorescent sequencing; single-stranded conformation polymorphism assays (SSCP); clamped denaturing gel electrophoresis (CDGE); denaturing gradient gel electrophoresis (DGGE) (Sheffield, V. C. et al. (19891) *Proc. Natl. Acad. Sci. USA* 86:232-236), mobility shift analysis (Orita, M. et al. (1989) *Proc. Natl. Acad. Sci. USA* 86:2766-2770), restriction enzyme analysis (Flavell et al. (1978) *Cell* 15:25; Geever, et al. (1981) *Proc. Natl. Acad. Sci. USA* 78:5081); heteroduplex analysis; chemical mismatch cleavage (CMC) (Cotton et al. (1985) *Proc. Natl. Acad. Sci. USA* 85:4397-4401); RNase protection assays (Myers, R. M. et al. (1985) *Science* 230:1242); use of polypeptides which recognize nucleotide mismatches, such as *E. coli* mutS protein; allele-specific PCR, for example.

In another embodiment of the invention, diagnosis of a susceptibility to schizophrenia can also be made by examining expression and/or composition of an NRG1 polypeptide, by a variety of methods, including enzyme linked immunosorbent assays (ELISAs), Western blots, immunoprecipitations and immunofluorescence. A test sample from an individual is assessed for the presence of an alteration in the expression and/or an alteration in composition of the polypeptide encoded by NRG1, or for the presence of a particular splicing variant encoded by NRG1. An alteration in expression of a polypeptide encoded by NRG1 can be, for example, an alteration in the quantitative polypeptide expression (i.e., the amount of polypeptide produced); an alteration in the composition of a polypeptide encoded by NRG1 is an alteration in the qualitative polypeptide expression (e.g., expression of a mutant NRG1 polypeptide or of a different splicing variant). In a preferred embodiment, diagnosis of a susceptibility to schizophrenia is made by detecting a particular splicing variant encoded by NRG1, or a particular pattern of splicing variants.

Both quantitative and qualitative alterations can also be present. An "alteration" in the polypeptide expression or composition, as used herein, refers to an alteration in expression or composition in a test sample, as compared with the expression or composition of polypeptide by NRG1 in a control sample. A control sample is a sample that corresponds to the test sample (e.g., is from the same type of cells), and is from an individual who is not affected by schizophrenia. An alteration in the expression or composition of the polypeptide in the test sample, as compared with the control sample, is indicative of a susceptibility to schizophrenia. Similarly, the presence of one or more different splicing variants in the test sample, or the presence of significantly different amounts of different splicing variants in the test sample, as compared with the control sample, is indicative of a susceptibility to schizophrenia. Various means of examining expression or composition of the polypeptide encoded by NRG1 can be used, including spectroscopy, colorimetry, electrophoresis, isoelectric focusing, and immunoassays (e.g., David et al., U.S. Pat. No. 4,376,110) such as immunoblotting (see also Current Protocols in Molecular Biology, particularly chapter 10). For example, in one embodiment, an antibody capable of binding to the polypeptide (e.g., as described above), preferably an antibody with a detectable label, can be used. Antibodies can be polyclonal, or more preferably, monoclonal. An intact antibody, or a fragment thereof (e.g., Fab or F(ab')₂) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

Western blotting analysis, using an antibody as described above that specifically binds to a polypeptide encoded by a mutant NRG1, or an antibody that specifically binds to a polypeptide encoded by a non-mutant gene, or an antibody that specifically binds to a particular splicing variant encoded by NRG1, can be used to identify the presence in a test sample of a particular splicing variant or of a polypeptide encoded by a polymorphic or mutant NRG1, or the absence in a test sample of a particular splicing variant or of a polypeptide encoded by a non-polymorphic or non-mutant gene. The presence of a polypeptide encoded by a polymorphic or mutant gene, or the absence of a polypeptide encoded by a non-polymorphic or non-mutant gene, is diagnostic for a susceptibility to schizophrenia, as is the presence (or absence) of particular splicing variants encoded by the neuregulin 1 gene.

In one embodiment of this method, the level or amount of polypeptide encoded by NRG1 in a test sample is compared with the level or amount of the polypeptide encoded by NRG1 in a control sample. A level or amount of the polypeptide in the test sample that is higher or lower than the level or amount of the polypeptide in the control sample, such that the difference is statistically significant, is indicative of an alteration in the expression of the polypeptide encoded by NRG1, and is diagnostic for a susceptibility to schizophrenia. Alternatively, the composition of the polypeptide encoded by NRG1 in a test sample is compared with the composition of the polypeptide encoded by NRG1 in a control sample. A difference in the composition of the polypeptide in the test sample, as compared with the composition of the polypeptide in the control sample (e.g., the presence of different splicing variants), is diagnostic for a susceptibility to schizophrenia. In another embodiment, both the level or amount and the composition of the polypeptide can be assessed in the test sample and in the control sample. A difference in the amount or level of the polypeptide in the test sample, compared to the control sample; a difference in composition in the test sample, compared to the control sample; or both a difference in the amount or level, and a difference in the composition, is indicative of a susceptibility to schizophrenia.

Figure 5:
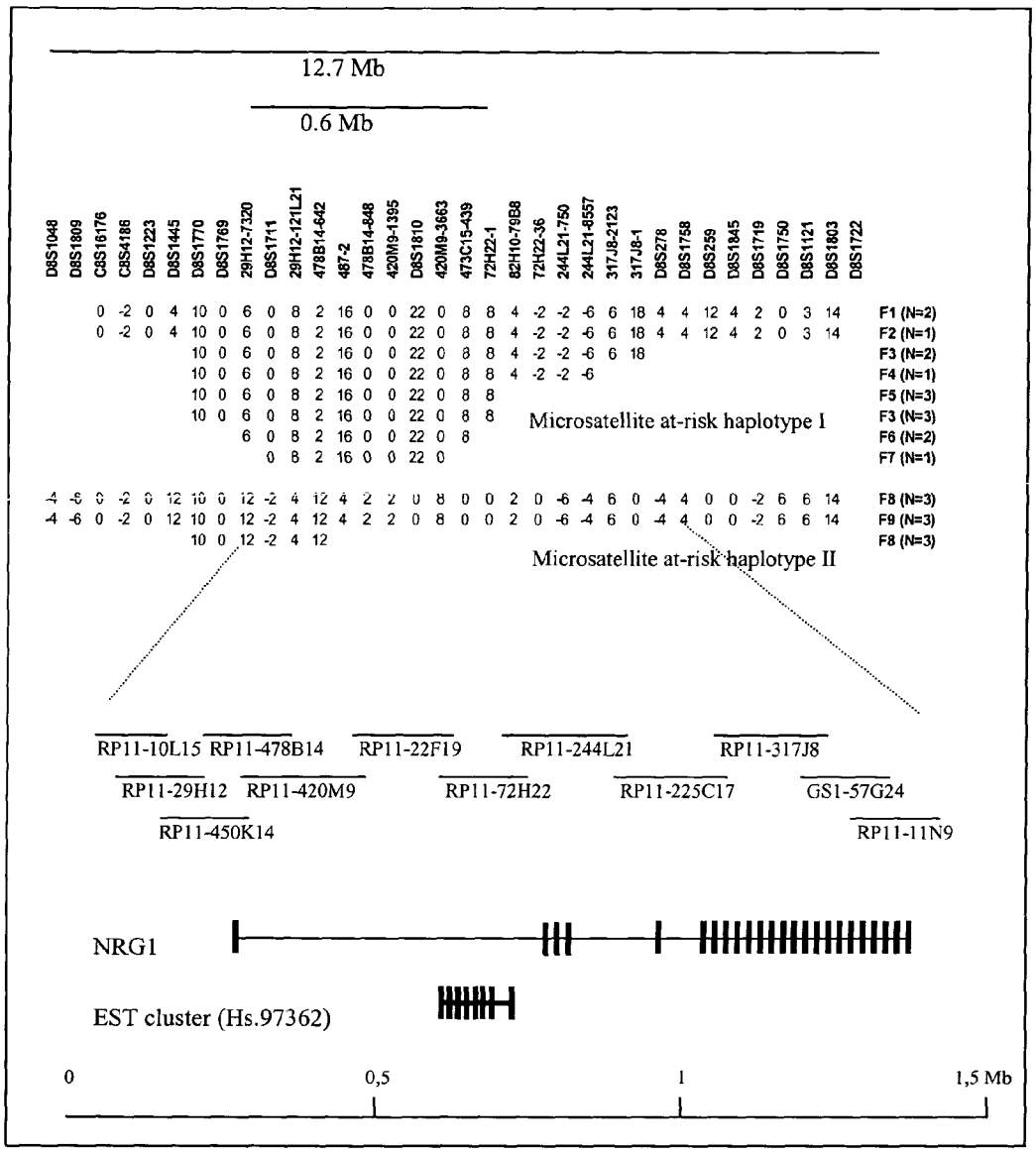
FIG. 5 shows extensive sharing of two microsatellite haplotypes (Gudbjartsson et al., Nature Genet. 25, 12 (2000)) between patients from the linkage families (shown at the top). Key markers in the haplotypes are shown and the size of the region is indicated. Families carrying the haplotypes are labeled F1-F9 and the number of affected individuals in each family carrying that haplotype is given in parentheses. Maximum haplotype sharing between families is 9.5 Mb for haplotype I and 11.4 Mb for haplotype II. Shared haplotypes between families narrow the region of interest down to a 600 kb region between markers 29H12-7320 and 473C15-439, indicated by a bar. Location of a BAC contig covering 1.5 Mb of the locus region is indicated. The sequence of GS1-57G24 was obtained from the public domain but we sequenced the other BACs shown. Exons are indicated by vertical bars.

The invention also pertains to methods of diagnosing a susceptibility to schizophrenia in an individual, comprising screening for an at-risk haplotype in neuregulin 1 gene that is more frequently present in an individual susceptible to schizophrenia (affected), compared to the frequency of its presence in a healthy individual (control), wherein the presence of the haplotype is indicative of a susceptibility to schizophrenia. See FIG. 5 and FIG. 6 for SNPs and markers that comprise haplotypes that can be used as screening tools. See also Tables 2 and 3 which set forth SNPs and markers and their counterpart sequence ID reference numbers. SNPs and markers from these lists represent the at-risk haplotype and can be used to design diagnostic tests for determining susceptibility to schizophrenia. In one embodiment, the at-risk haplotype is characterized by the presence of: SNP8NRG221132 (SEQ ID NO: 1372), SNP8NRG221533 (SEQ ID NO: 1373), SNP8NRG241930 (SEQ ID NO: 1669), SNP8NRG243177 (SEQ ID NO: 1670), SNP8NRG433E1006 (single nucleotide polymorphism "r" at position 433 of SEQ ID NO: 104 in exon E1006A), microsatellite marker 478B14-848 (SEQ ID NOs: 55 and 56), and microsatellite marker 420M9-1395 (SEQ ID NOs: 57 and 58). In another embodiment, the at-risk halpotype is further characterized by the presence of one or a combination of: SNP8NRG85307DEL25 (SEQ ID NO: 1375), SNP8NRG103492 (SEQ ID NO: 1533), SNP8NRG157556 (SEQ ID NO: 1668), microsatellite marker D8S1810 (Accession number: GDB: 613185), SNP8NRG444511 (SEQ ID NO: 1671), SNP8NRG449280 (SEQ ID NO: 1672), microsatellite marker TSC0707270 (SEQ ID NO: 1673) and microsatellite marker TSC0707290 (SEQ ID NO: 1674). In yet another embodiment, the at-risk haplotype is selected from the group consisting of: HapA, HapB, HapC1 and HapC. In a preferred embodiment, the at-risk haplotype is characterized by the presence of: SNP8NRG221533, microsatellite marker 478B14-848, and microsatellite marker 420M9-1395. In the most preferred embodiment, the at-risk haplotype is characterized by the presence of SNP8NRG221533.

Kits (e.g., reagent kits) useful in the methods of diagnosis comprise components useful in any of the methods described herein, including for example, hybridization probes or primers as described herein (e.g., labeled probes or primers), reagents for detection of labeled molecules, restriction enzymes (e.g., for RFLP analysis), allele-specific oligonucleotides, antibodies which bind to mutant or to non-mutant (native) NRG1 polypeptide (e.g., to any one (or more) of SEQ ID NO:2-5 or 10-39), means for amplification of nucleic acids comprising NRG1, or means for analyzing the nucleic acid sequence of NRG1 or for analyzing the amino acid sequence of an NRG1 polypeptide, etc.

Screening Assays and Agents Identified Thereby

The invention provides methods (also referred to herein as "screening assays") for identifying the presence of a nucleotide that hybridizes to a nucleic acid of the invention, as well as for identifying the presence of a polypeptide encoded by a nucleic acid of the invention. In one embodiment, the presence (or absence) of a nucleic acid molecule of interest (e.g., a nucleic acid that has significant homology with a nucleic acid of the invention) in a sample can be assessed by contacting the sample with a nucleic acid comprising a nucleic acid of the invention (e.g., a nucleic acid having the sequence of SEQ ID NO: 1 or the complement of SEQ ID NO: 1, or a nucleic acid encoding an amino acid having the sequence of any one of SEQ ID NO: 2-5 or 10-39, or a fragment or variant of such nucleic acids), under high stringency conditions as described above, and then assessing the sample for the presence (or absence) of hybridization. In a preferred embodiment, the high stringency conditions are conditions appropriate for selective hybridization. In a preferred embodiment, the high stringency conditions are conditions appropriate for selective hybridization. In another embodiment, a sample containing the nucleic acid molecule of interest is contacted with a nucleic acid containing a contiguous nucleotide sequence (e.g., a primer or a probe as described above) that is at least partially complementary to a part of the nucleic acid molecule of interest (e.g., a neuregulin 1 nucleic acid), and the contacted sample is assessed for the presence or absence of hybridization. In a preferred embodiment, the nucleic acid containing a contiguous nucleotide sequence is completely complementary to a part of the nucleic acid molecule of interest.

In any of these embodiment, all or a portion of the nucleic acid of interest can be subjected to amplification prior to performing the hybridization.

In another embodiment, the presence (or absence) of a polypeptide of interest, such as a polypeptide of the invention or a fragment or variant thereof, in a sample can be assessed by contacting the sample with an antibody that specifically hybridizes to the polypeptide of interest (e.g., an antibody such as those described above), and then assessing the sample for the presence (or absence) of binding of the antibody to the polypeptide of interest.

In another embodiment, the invention provides methods for identifying agents (e.g., fusion proteins, polypeptides, peptidomimetics, prodrugs, receptors, binding agents, antibodies, small molecules or other drugs, or ribozymes) which alter (e.g., increase or decrease) the activity of the polypeptides described herein, or which otherwise interact with the polypeptides herein. For example, such agents can be agents which bind to polypeptides described herein (e.g., NRG1 binding agents); which have a stimulatory or inhibitory effect on, for example, activity of polypeptides of the invention; which change (e.g., enhance or inhibit) the ability of the polypeptides of the invention to interact with NRG1 binding agents (e.g., receptors or other binding agents); or which alter posttranslational processing of the NRG1 polypeptide (e.g., agents that alter proteolytic processing to direct the polypeptide from where it is normally synthesized to another location in the cell, such as the cell surface; agents that alter proteolytic processing such that more active polypeptide is released from the cell, etc.).

In one embodiment, the invention provides assays for screening candidate or test agents that bind to or modulate the activity of polypeptides described herein (or biologically or enzymatically active portion(s) thereof), as well as agents identifiable by the assays. Test agents can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to polypeptide libraries, while the other four approaches are applicable to polypeptide, non-peptide oligomer or small molecule libraries of compounds (Lam, K. S. (1997) *Anticancer Drug Des.*, 12:145).

In one embodiment, to identify agents which alter the activity of an NRG1 polypeptide, a cell, cell lysate, or solution containing or expressing an NRG1 polypeptide (e.g., SEQ ID NO: 2-5 or 10-39, or another splicing variant encoded by NRG1), or a fragment or derivative thereof (as described above), can be contacted with an agent to be tested; alternatively, the polypeptide can be contacted directly with the agent to be tested. The level (amount) of NRG1 activity is assessed (e.g., the level (amount) of NRG1 activity is measured, either directly or indirectly), and is compared with the level of activity in a control (i.e., the level of activity of the NRG 1 polypeptide or fragment or derivative thereof in the absence of the agent to be tested). If the level of the activity in the presence of the agent differs, by an amount that is statistically significant, from the level of the activity in the absence of the agent, then the agent is an agent that alters the activity of NRG1 polypeptide. An increase in the level of NRG1 polypeptide activity relative to a control, indicates that the agent is an agent that enhances (is an agonist of) NRG1 activity. Similarly, a decrease in the level of NRG1 polypeptide activity relative to a control, indicates that the agent is an agent that inhibits (is an antagonist of) NRG1 activity. In another embodiment, the level of activity of an NRG1 polypeptide or derivative or fragment thereof in the presence of the agent to be tested, is compared with a control level that has previously been established. A level of the activity in the presence of the agent that differs from the control level by an amount that is statistically significant indicates that the agent alters NRG1 activity.

The present invention also relates to an assay for identifying agents which alter the expression of NRG1 (e.g., antisense nucleic acids, fusion proteins, polypeptides, peptidomimetics, prodrugs, receptors, binding agents, antibodies, small molecules or other drugs, or ribozymes) which alter (e.g., increase or decrease) expression (e.g., transcription or translation) of the gene or which otherwise interact with the nucleic acids described herein, as well as agents identifiable by the assays. For example, a solution containing a nucleic acid encoding NRG1 polypeptide (e.g., NRG1) can be contacted with an agent to be tested. The solution can comprise, for example, cells containing the nucleic acid or cell lysate containing the nucleic acid; alternatively, the solution can be another solution which comprises elements necessary for transcription/translation of the nucleic acid. Cells not suspended in solution can also be employed, if desired. The level and/or pattern of NRG1 expression (e.g., the level and/or pattern of mRNA or of protein expressed, such as the level and/or pattern of different splicing variants) is assessed, and is compared with the level and/or pattern of expression in a control (i.e., the level and/or pattern of the NRG1 expression in the absence of the agent to be tested). If the level and/or pattern in the presence of the agent differs, by an amount or in a manner that is statistically significant, from the level and/or pattern in the absence of the agent, then the agent is an agent that alters the expression of NRG1. Enhancement of NRG1 expression indicates that the agent is an agonist of NRG1 activity. Similarly, inhibition of NRG1 expression indicates that the agent is an antagonist of NRG1 activity. In another embodiment, the level and/or pattern of NRG1 polypeptide(s) (e.g., different splicing variants) in the presence of the agent to be tested, is compared with a control level and/or pattern that has previously been established. A level and/or pattern in the presence of the agent that differs from the control level and/or pattern by an amount or in a manner that is statistically significant indicates that the agent alters NRG1 expression.

In another embodiment of the invention, agents which alter the expression of the neuregulin 1 gene or which otherwise interact with the nucleic acids described herein, can be identified using a cell, cell lysate, or solution containing a nucleic acid encoding the promoter region of the neuregulin 1 gene operably linked to a reporter gene. After contact with an agent to be tested, the level of expression of the reporter gene (e.g., the level of mRNA or of protein expressed) is assessed, and is compared with the level of expression in a control (i.e., the level of the expression of the reporter gene in the absence of the agent to be tested). If the level in the presence of the agent differs, by an amount or in a manner that is statistically significant, from the level in the absence of the agent, then the agent is an agent that alters the expression of NRG1, as indicated by its ability to alter expression of a gene that is operably linked to the NRG1 promoter. Enhancement of the expression of the reporter indicates that the agent is an agonist of NRG1 activity. Similarly, inhibition of the expression of the reporter indicates that the agent is an antagonist of NRG1 activity. In another embodiment, the level of expression of the reporter in the presence of the agent to be tested, is compared with a control level that has previously been established. A level in the presence of the agent that differs from the control level by an amount or in a manner that is statistically significant indicates that the agent alters NRG1 expression.

Agents which alter the amounts of different splicing variants encoded by NRG1 (e.g., an agent which enhances activity of a first splicing variant, and which inhibits activity of a second splicing variant), as well as agents which are agonists of activity of a first splicing variant and antagonists of activity of a second splicing variant, can easily be identified using these methods described above.

In other embodiments of the invention, assays can be used to assess the impact of a test agent on the activity of an NRG1 polypeptide in relation to an NRG1 binding agent. For example, a cell that expresses a compound that interacts with NRG1 polypeptide (herein referred to as a "NRG1 binding agent", which can be a polypeptide or other molecule that interacts with NRG1 polypeptide, such as a receptor) is contacted with NRG1 polypeptide in the presence of a test agent, and the ability of the test agent to alter the interaction between NRG1 polypeptide and the NRG1 binding agent is determined. Alternatively, a cell lysate or a solution containing the NRG1 binding agent, can be used. An agent which binds to NRG1 polypeptide or the NRG1 binding agent can alter the interaction by interfering with, or enhancing the ability of NRG1 polypeptide to bind to, associate with, or otherwise interact with the NRG1 binding agent. Determining the ability of the test agent to bind to NRG1 polypeptide or an NRG1 binding agent can be accomplished, for example, by coupling the test agent with a radioisotope or enzymatic label such that binding of the test agent to the polypeptide can be determined by detecting the labeled with $^{125}I$, $^{35}S$, $^{14}C$ or $^{3}H$, either directly or indirectly, and the radioisotope detected by direct counting of radioemmission or by scintillation counting. Alternatively, test agents can be enzymatically labeled with, for example, horseradish peroxidase, alkaline phosphatase, or luciferase, and the enzymatic label detected by determination of conversion of an appropriate substrate to product. It is also within the scope of this invention to determine the ability of a test agent to interact with the polypeptide without the labeling of any of the interactants. For example, a microphysiometer can be used to detect the interaction of a test agent with NRG1 polypeptide or an NRG1 binding agent without the labeling of either the test agent, NRG1 polypeptide, or the NRG1 binding agent. McConnell, H. M. et al. (1992) *Science*, 257:1906-1912. As used herein, a "microphysiometer" (e.g., Cytosensor™) is an analytical instrument that measures the rate at which a cell acidifies its environment using a light-addressable potentiometric sensor (LAPS). Changes in this acidification rate can be used as an indicator of the interaction between ligand and polypeptide.

In another embodiment of the invention, assays can be used to identify polypeptides that interact with one or more NRG1 polypeptides, as described herein. For example, a yeast two-hybrid system such as that described by Fields and Song (Fields, S. and Song, O., *Nature* 340:245-246 (1989)) can be used to identify polypeptides that interact with one or more NRG1 polypeptides. In such a yeast two-hybrid system, vectors are constructed based on the flexibility of a transcription factor which has two functional domains (a DNA binding domain and a transcription activation domain). If the two domains are separated but fused to two different proteins that interact with one another, transcriptional activation can be achieved, and transcription of specific markers (e.g., nutritional markers such as His and Ade, or color markers such as lacZ) can be used to identify the presence of interaction and transcriptional activation. For example, in the methods of the invention, a first vector is used which includes a nucleic acid encoding a DNA binding domain and also an NRG1 polypeptide, splicing variant, or fragment or derivative thereof, and a second vector is used which includes a nucleic acid encoding a transcription activation domain and also a nucleic acid encoding a polypeptide which potentially may interact with the NRG1 polypeptide, splicing variant, or fragment or derivative thereof (e.g., a NRG1 polypeptide binding agent or receptor). Incubation of yeast containing the first vector and the second vector under appropriate conditions (e.g., mating conditions such as used in the Matchmaker™ system from Clontech) allows identification of colonies which express the markers of interest. These colonies can be examined to identify the polypeptide(s) which interact with the NRG1 polypeptide or fragment or derivative thereof. Such polypeptides may be useful as agents which alter the activity of expression of an NRG1 polypeptide, as described above.

In more than one embodiment of the above assay methods of the present invention, it may be desirable to immobilize either NRG1 polypeptide, the NRG1 binding agent, or other components of the assay on a solid support, in order to facilitate separation of complexed from uncomplexed forms of one or both of the polypeptides, as well as to accommodate automation of the assay. Binding of a test agent to the polypeptide, or interaction of the polypeptide with a binding agent in the presence and absence of a test agent, can be accomplished in any vessel suitable for containing the reactants. Examples of such vessels include microtitre plates, test tubes, and microcentrifuge tubes. In one embodiment, a fusion protein (e.g., a glutathione-S-transferase fusion protein) can be provided which adds a domain that allows NRG1 polypeptide or an NRG1 binding agent to be bound to a matrix or other solid support.

In another embodiment, modulators of expression of nucleic acid molecules of the invention are identified in a method wherein a cell, cell lysate, or solution containing a nucleic acid encoding NRG1 polypeptide is contacted with a test agent and the expression of appropriate mRNA or polypeptide (e.g., splicing variant(s)) in the cell, cell lysate, or solution, is determined. The level of expression of appropriate mRNA or polypeptide(s) in the presence of the test agent is compared to the level of expression of mRNA or polypeptide(s) in the absence of the test agent. The test agent can then be identified as a modulator of expression based on this comparison. For example, when expression of mRNA or polypeptide is greater (statistically significantly greater) in the presence of the test agent than in its absence, the test agent is identified as a stimulator or enhancer of the mRNA or polypeptide expression. Alternatively, when expression of the mRNA or polypeptide is less (statistically significantly less) in the presence of the test agent than in its absence, the test agent is identified as an inhibitor of the mRNA or polypeptide expression. The level of mRNA or polypeptide expression in the cells can be determined by methods described herein for detecting mRNA or polypeptide.

In yet another embodiment, the invention provides methods for identifying agents (e.g., fusion proteins, polypeptides, peptidomimetics, prodrugs, receptors, binding agents, antibodies, small molecules or other drugs, or ribozymes) which alter (e.g., increase or decrease) the activity of an NRG1 binding agent, as described herein. For example, such agents can be agents which have a stimulatory or inhibitory effect on, for example, the activity of an NRG1 binding agent; which change (e.g., enhance or inhibit) the ability NRG1 binding agents (e.g., receptors or other binding agents) to interact with the polypeptides of the invention; or which alter posttranslational processing of the NRG1 binding agent (e.g., agents that alter proteolytic processing to direct the NRG1 binding agent from where it is normally synthesized to another location in the cell, such as the cell surface; agents that alter proteolytic processing such that more active NRG1 binding agent is released from the cell, etc.).

For example, the invention provides assays for screening candidate or test agents that bind to or modulate the activity of an NRG1 binding agent described herein (or enzymatically active portion(s) thereof), as well as agents identifiable by the assays. As described above, test agents can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to polypeptide libraries, while the other four approaches are applicable to polypeptide, non-peptide oligomer or small molecule libraries of compounds (Lam, K. S. (1997) *Anticancer Drug Des.*, 12:145).

In one embodiment, to identify agents which alter the activity of an NRG1 binding agent, a cell, cell lysate, or solution containing or expressing an NRG1 binding agent (e.g., an ErbB protein, such as ErbB2, ErbB3, and/or ErbB4 protein), or a fragment (e.g., an enzymatically active fragment) or derivative thereof (as described above), for example, fragments of the ErbB4 receptor such as fragments (1) (aa 713-988), fragment (2) (aa 767-1308), fragment (3) (aa 676-1030), fragment 4 (aa 676-1119), fragment 5 (aa 676-1213), and/or fragment (6) (aa 676-1308), as described below, or a derivative thereof, can be contacted with an agent to be tested; alternatively, the NRG1 binding agent (or fragment or derivative thereof) can be contacted directly with the agent to be tested. The level (amount) of NRG1 binding agent activity is assessed (e.g., the level (amount) of NRG1 binding agent activity is measured, either directly or indirectly), and is compared with the level of activity in a control (i.e., the level of activity of the NRG1 binding agent or fragment or derivative thereof in the absence of the agent to be tested). If the level of the activity in the presence of the agent differs, by an amount that is statistically significant, from the level of the activity in the absence of the agent, then the agent is an agent that alters the activity of NRG1 binding agent. An increase in the level of NRG1 binding agent activity relative to a control, indicates that the agent is an agent that enhances (is an agonist of) NRG1 binding agent activity. Similarly, a decrease in the level of NRG1 binding agent activity relative to a control, indicates that the agent is an agent that inhibits (is an antagonist of) NRG1 binding agent activity. In another embodiment, the level of activity of an NRG1 binding agent or derivative or fragment thereof in the presence of the agent to be tested, is compared with a control level that has previously been established. A level of the activity in the presence of the agent that differs from the control level by an amount that is statistically significant indicates that the agent alters NRG1 binding agent activity.

This invention further pertains to novel agents identified by the above-described screening assays. Accordingly, it is within the scope of this invention to further use an agent identified as described herein in an appropriate animal model. For example, an agent identified as described herein (e.g., a test agent that is a modulating agent, an antisense nucleic acid molecule, a specific antibody, or a polypeptide-binding agent) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein. In addition, an agent identified as described herein can be used to alter activity of a polypeptide encoded by neuregulin 1, or to alter expression of neuregulin 1, by contacting the polypeptide or the gene (or contacting a cell comprising the polypeptide or the gene) with the agent identified as described herein.

Pharmaceutical Compositions

The present invention also pertains to pharmaceutical compositions comprising nucleic acids described herein, particularly nucleotides encoding the polypeptides described herein; comprising polypeptides described herein (e.g., one or more of SEQ ID NO: 2-5 or 10-39, and/or other splicing variants encoded by NRG1); comprising an NRG1 therapeutic agent, as described below; and/or comprising an agent that alters (e.g., enhances or inhibits) NRG1 expression or NRG1 polypeptide activity as described herein. For instance, a polypeptide, protein (e.g., an NRG1 receptor), fragment, fusion protein or prodrug thereof, or a nucleotide or nucleic acid construct (vector) comprising a nucleotide of the present invention, an agent that alters NRG1 polypeptide activity, an agent that alters neuregulin 1 gene expression, or an NRG1 binding agent or binding partner (e.g., a receptor or other molecule that binds to or otherwise interacts with NRG1 polypeptide), can be formulated with a physiologically acceptable carrier or excipient to prepare a pharmaceutical composition. The carrier and composition can be sterile. The formulation should suit the mode of administration.

Suitable pharmaceutically acceptable carriers include but are not limited to water, salt solutions (e.g., NaCl), saline, buffered saline, alcohols, glycerol, ethanol, gum arabic, vegetable oils, benzyl alcohols, polyethylene glycols, gelatin, carbohydrates such as lactose, amylose or starch, dextrose, magnesium stearate, talc, silicic acid, viscous paraffin, perfume oil, fatty acid esters, hydroxymethylcellulose, polyvinyl pyrolidone, etc., as well as combinations thereof. The pharmaceutical preparations can, if desired, be mixed with auxiliary agents, e.g., lubricants, preservatives, stabilizers, wetting agents, emulsifiers, salts for influencing osmotic pressure, buffers, coloring, flavoring and/or aromatic substances and the like which do not deleteriously react with the active agents.

The composition, if desired, can also contain minor amounts of wetting or emulsifying agents, or pH buffering agents. The composition can be a liquid solution, suspension, emulsion, tablet, pill, capsule, sustained release formulation, or powder. The composition can be formulated as a suppository, with traditional binders and carriers such as triglycerides. Oral formulation can include standard carriers such as pharmaceutical grades of mannitol, lactose, starch, magnesium stearate, polyvinyl pyrollidone, sodium saccharine, cellulose, magnesium carbonate, etc.

Methods of introduction of these compositions include, but are not limited to, intradermal, intramuscular, intraperitoneal, intraocular, intravenous, subcutaneous, topical, oral and intranasal. Other suitable methods of introduction can also include gene therapy (as described below), rechargeable or biodegradable devices, particle acceleration devises ("gene guns") and slow release polymeric devices. The pharmaceutical compositions of this invention can also be administered as part of a combinatorial therapy with other agents.

The composition can be formulated in accordance with the routine procedures as a pharmaceutical composition adapted for administration to human beings. For example, compositions for intravenous administration typically are solutions in sterile isotonic aqueous buffer. Where necessary, the composition may also include a solubilizing agent and a local anesthetic to ease pain at the site of the injection. Generally, the ingredients are supplied either separately or mixed together in unit dosage form, for example, as a dry lyophilized powder or water free concentrate in a hermetically sealed container such as an ampule or sachette indicating the quantity of active agent. Where the composition is to be administered by infusion, it can be dispensed with an infusion bottle containing sterile pharmaceutical grade water, saline or dextrose/water. Where the composition is administered by injection, an ampule of sterile water for injection or saline can be provided so that the ingredients may be mixed prior to administration.

For topical application, nonsprayable forms, viscous to semi-solid or solid forms comprising a carrier compatible with topical application and having a dynamic viscosity preferably greater than water, can be employed. Suitable formulations include but are not limited to solutions, suspensions, emulsions, creams, ointments, powders, enemas, lotions, sols, liniments, salves, aerosols, etc., which are, if desired, sterilized or mixed with auxiliary agents, e.g., preservatives, stabilizers, wetting agents, buffers or salts for influencing osmotic pressure, etc. The agent may be incorporated into a cosmetic formulation. For topical application, also suitable are sprayable aerosol preparations wherein the active ingredient, preferably in combination with a solid or liquid inert carrier material, is packaged in a squeeze bottle or in admixture with a pressurized volatile, normally gaseous propellant, e.g., pressurized air.

Agents described herein can be formulated as neutral or salt forms. Pharmaceutically acceptable salts include those formed with free amino groups such as those derived from hydrochloric, phosphoric, acetic, oxalic, tartaric acids, etc., and those formed with free carboxyl groups such as those derived from sodium, potassium, ammonium, calcium, ferric hydroxides, isopropylamine, triethylamine, 2-ethylamino ethanol, histidine, procaine, etc.

The agents are administered in a therapeutically effective amount. The amount of agents which will be therapeutically effective in the treatment of a particular disorder or condition will depend on the nature of the disorder or condition, and can be determined by standard clinical techniques. In addition, in vitro or in vivo assays may optionally be employed to help identify optimal dosage ranges. The precise dose to be employed in the formulation will also depend on the route of administration, and the seriousness of the symptoms of schizophrenia, and should be decided according to the judgment of a practitioner and each patient's circumstances. Effective doses may be extrapolated from dose-response curves derived from in vitro or animal model test systems.

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use of sale for human administration. The pack or kit can be labeled with information regarding mode of administration, sequence of drug administration (e.g., separately, sequentially or concurrently), or the like. The pack or kit may also include means for reminding the patient to take the therapy. The pack or kit can be a single unit dosage of the combination therapy or it can be a plurality of unit dosages. In particular, the agents can be separated, mixed together in any combination, present in a single vial or tablet. Agents assembled in a blister pack or other dispensing means is preferred. For the purpose of this invention, unit dosage is intended to mean a dosage that is dependent on the individual pharmacodynamics of each agent and administered in FDA approved dosages in standard time courses.

Methods of Therapy

The present invention also pertains to methods of treatment (prophylactic and/or therapeutic) for schizophrenia, using an NRG1 therapeutic agent. An "NRG1 therapeutic agent" is an agent, used for the treatment of schizophrenia, that alters (e.g., enhances or inhibits) NRG1 polypeptide activity and/or neuregulin 1 gene expression, as described herein (e.g., an NRG1 agonist or antagonist). NRG1 therapeutic agents can alter NRG1 polypeptide activity or gene expression by a variety of means, such as, for example, by providing additional NRG1 polypeptide or by upregulating the transcription or translation of NRG1; by altering posttranslational processing of the NRG1 polypeptide; by altering transcription of NRG1 splicing variants; by interfering with NRG1 polypeptide activity (e.g., by binding to an NRG1 polypeptide); by altering the interaction between NRG1 polypeptide and an NRG1 polypeptide binding agent (e.g., a receptor); by altering the activity of an NRG1 polypeptide binding agent; or by downregulating the transcription or translation of NRG1. Representative NRG1 therapeutic agents include the following:

nucleic acids or fragments or derivatives thereof described herein, particularly nucleotides encoding the polypeptides described herein and vectors comprising such nucleic acids (e.g., a gene, cDNA, and/or mRNA, such as a nucleic acid encoding an NRG1 polypeptide or active fragment or derivative thereof, or an oligonucleotide; for example, SEQ ID NO: 1 or a nucleic acid encoding any one (or more) of SEQ ID NO: 2-5 or 10-39, or fragments or derivatives thereof);

polypeptides described herein (e.g., one or more of SEQ ID NO: 2-5 or 10-39, and/or other splicing variants encoded by NRG1, or fragments or derivatives thereof);

other polypeptides (e.g., NRG1 receptors, such as ErbB receptors, including ErbB2, ErbB3, ErbB4; enzymatically active fragments of ErbB receptors (i.e., fragments that demonstrate the enzymatic activity of the ErbB receptor) and particularly of the ErbB4 receptor such as fragment (1) (aa 713-988), fragment (2) (aa 676-1308), fragment (3) (aa 676-1030), fragment 4 (aa 676-1119), fragment (5) (aa 676-1213), and/or fragment (6) (aa 676-1308), as described below, or derivatives thereof; and heterodimers of ErbB2/ErbB4, ErbB2/ErbB3 and ErbB3/ErbB4, including heterodimers of fragments of ErbB2, ErbB3, and/or ErbB4, particularly enzymatically active fragments thereof);

NRG1 binding agents; peptidomimetics; fusion proteins or prodrugs thereof; antibodies (e.g., an antibody to a mutant NRG1 polypeptide, or an antibody to a non-mutant NRG1 polypeptide, or an antibody to a particular splicing variant encoded by NRG1, as described above); ribozymes; other small molecules;

agents that alter interaction between NRG1 polypeptide and an NRG1 polypeptide binding agent (e.g., an agent that alters interaction between NRG1 polypeptide and ErbB4 receptor); agents that alter activity of an NRG1 polypeptide binding agent (e.g., an agent that alters (e.g., enhances or inhibits) expression and/or activity of an NRG1 polypeptide binding agent, for example, an agent that enhances activity of ErbB4);

and other agents that alter (e.g., enhance or inhibit) neuregulin 1 gene expression or polypeptide activity, that alter posttranslational processing of the NRG1 polypeptide, or that regulate transcription of NRG1 splicing variants (e.g., agents that affect which splicing variants are expressed, or that affect the amount of each splicing variant that is expressed).

In a preferred embodiment, the NRG1 therapeutic agent is a nucleic acid encoding one or more NRG1 polypeptides (e.g., encoding one or more of SEQ ID NO: 2-5 or 10-39, or a fragment or derivative thereof); in another preferred embodiment, the NRG1 therapeutic agent is a nucleic acid comprising a fragment of NRG1 (e.g., comprising a fragment of SEQ ID NO: 1, or a derivative thereof), such as a regulatory region of NRG1; in yet another preferred embodiment, the NRG1 therapeutic agent is a nucleic acid comprising the NRG1 regulatory region and also a nucleic acid encoding one or more NRG1 polypeptides (or fragments or derivatives thereof).

More than one NRG1 therapeutic agent can be used concurrently, if desired.

The NRG1 therapeutic agent that is a nucleic acid is used in the treatment of schizophrenia. The term, "treatment" as used herein, refers not only to ameliorating symptoms associated with the disease, but also preventing or delaying the onset of the disease, and also lessening the severity or frequency of symptoms of the disease. The therapy is designed to alter (e.g., inhibit or enhance), replace or supplement activity of an NRG1 polypeptide in an individual. For example, an NRG1 therapeutic agent can be administered in order to upregulate or increase the expression or availability of the neuregulin 1 gene or of specific splicing variants of NRG1, or, conversely, to downregulate or decrease the expression or availability of the neuregulin 1 gene or specific splicing variants of NRG1. Upregulation or increasing expression or availability of a native NRG1 or of a particular splicing variant could interfere with or compensate for the expression or activity of a defective gene or another splicing variant; downregulation or decreasing expression or availability of a native NRG1 or of a particular splicing variant could minimize the expression or activity of a defective gene or the particular splicing variant and thereby minimize the impact of the defective gene or the particular splicing variant.

The NRG1 therapeutic agent(s) are administered in a therapeutically effective amount (i.e., an amount that is sufficient to treat the disease, such as by ameliorating symptoms associated with the disease, preventing or delaying the onset of the disease, and/or also lessening the severity or frequency of symptoms of the disease). The amount which will be therapeutically effective in the treatment of a particular individual's disorder or condition will depend on the symptoms and severity of the disease, and can be determined by standard clinical techniques. In addition, in vitro or in vivo assays may optionally be employed to help identify optimal dosage ranges. The precise dose to be employed in the formulation will also depend on the route of administration, and the seriousness of the disease or disorder, and should be decided according to the judgment of a practitioner and each patient's circumstances. Effective doses may be extrapolated from dose-response curves derived from in vitro or animal model test systems.

In one embodiment, a nucleic acid of the invention (e.g., a nucleic acid encoding an NRG1 polypeptide, such as SEQ ID NO: 1; or another nucleic acid that encodes an NRG1 polypeptide or a splicing variant, derivative or fragment thereof, such as a nucleic acid encoding any one or more of SEQ ID NO: 2-5 or 10-39) can be used, either alone or in a pharmaceutical composition as described above. For example, NRG1 or a cDNA encoding the NRG1 polypeptide, either by itself or included within a vector, can be introduced into cells (either in vitro or in vivo) such that the cells produce native NRG1 polypeptide. If necessary, cells that have been transformed with the gene or cDNA or a vector comprising the gene or cDNA can be introduced (or re-introduced) into an individual affected with the disease. Thus, cells which, in nature, lack native NRG1 expression and activity, or have mutant NRG1 expression and activity, or have expression of a disease-associated NRG1 splicing variant, can be engineered to express NRG1 polypeptide or an active fragment of the NRG1 polypeptide (or a different variant of NRG1 polypeptide). In a preferred embodiment, nucleic acid encoding the NRG1 polypeptide, or an active fragment or derivative thereof, can be introduced into an expression vector, such as a viral vector, and the vector can be introduced into appropriate cells in an animal. Other gene transfer systems, including viral and nonviral transfer systems, can be used. Alternatively, nonviral gene transfer methods, such as calcium phosphate coprecipitation, mechanical techniques (e.g., microinjection); membrane fusion-mediated transfer via liposomes; or direct DNA uptake, can also be used.

Alternatively, in another embodiment of the invention, a nucleic acid of the invention; a nucleic acid complementary to a nucleic acid of the invention; or a portion of such a nucleic acid (e.g., an oligonucleotide as described below), can be used in "antisense" therapy, in which a nucleic acid (e.g., an oligonucleotide) which specifically hybridizes to the mRNA and/or genomic DNA of NRG1 is administered or generated in situ. The antisense nucleic acid that specifically hybridizes to the mRNA and/or DNA inhibits expression of the NRG1 polypeptide, e.g., by inhibiting translation and/or transcription. Binding of the antisense nucleic acid can be by conventional base pair complementarity, or, for example, in the case of binding to DNA duplexes, through specific interaction in the major groove of the double helix.

An antisense construct of the present invention can be delivered, for example, as an expression plasmid as described above. When the plasmid is transcribed in the cell, it produces RNA which is complementary to a portion of the mRNA and/or DNA which encodes NRG1 polypeptide. Alternatively, the antisense construct can be an oligonucleotide probe which is generated ex vivo and introduced into cells; it then inhibits expression by hybridizing with the mRNA and/or genomic DNA of NRG1. In one embodiment, the oligonucleotide probes are modified oligonucleotides which are resistant to endogenous nucleases, e.g. exonucleases and/or endonucleases, thereby rendering them stable in vivo. Exemplary nucleic acid molecules for use as antisense oligonucleotides are phosphoramidate, phosphothioate and methylphosphonate analogs of DNA (see also U.S. Pat. Nos. 5,176,996; 5,264,564; and 5,256,775). Additionally, general approaches to constructing oligomers useful in antisense therapy are also described, for example, by Van der Krol et al. ((1988) *Biotechniques* 6:958-976); and Stein et al. ((1988) *Cancer Res* 48:2659-2668). With respect to antisense DNA, oligodeoxyribonucleotides derived from the translation initiation site, e.g. between the −10 and +10 regions of NRG1 sequence, are preferred.

To perform antisense therapy, oligonucleotides (mRNA, cDNA or DNA) are designed that are complementary to mRNA encoding NRG1. The antisense oligonucleotides bind to NRG1 mRNA transcripts and prevent translation. Absolute complementarity, although preferred, is not required. A sequence "complementary" to a portion of an RNA, as referred to herein, indicates that a sequence has sufficient complementarity to be able to hybridize with the RNA, forming a stable duplex; in the case of double-stranded antisense nucleic acids, a single strand of the duplex DNA may thus be tested, or triplex formation may be assayed. The ability to hybridize will depend on both the degree of complementarity and the length of the antisense nucleic acid, as described in detail above. Generally, the longer the hybridizing nucleic acid, the more base mismatches with an RNA it may contain and still form a stable duplex (or triplex, as the case may be). One skilled in the art can ascertain a tolerable degree of mismatch by use of standard procedures.

The oligonucleotides used in antisense therapy can be DNA, RNA, or chimeric mixtures or derivatives or modified versions thereof, single-stranded or double-stranded. The oligonucleotides can be modified at the base moiety, sugar moiety, or phosphate backbone, for example, to improve stability of the molecule, hybridization, etc. The oligonucleotides can include other appended groups such as peptides (e.g. for targeting host cell receptors in vivo), or agents facilitating transport across the cell membrane (see, e.g., Letsinger et al. (1989) Proc. Natl. Acad. Sci. USA 86:6553-6556; Lemaitre et al., (1987), Proc. Natl. Acad Sci. USA 84:648-652; PCT International Publication No. WO88/09810) or the blood-brain barrier (see, e.g., PCT International Publication No. WO89/10134), or hybridization-triggered cleavage agents (see, e.g., Krol et al. (1988) BioTechniques 6:958-976) or intercalating agents. (See, e.g., Zon, (1988), Pharm. Res. 5:539-549). To this end, the oligonucleotide may be conjugated to another molecule (e.g., a peptide, hybridization triggered cross-linking agent, transport agent, hybridization-triggered cleavage agent).

The antisense molecules are delivered to cells which express NRG1 in vivo. A number of methods can be used for delivering antisense DNA or RNA to cells; e.g., antisense molecules can be injected directly into the tissue site, or modified antisense molecules, designed to target the desired cells (e.g., antisense linked to peptides or antibodies that specifically bind receptors or antigens expressed on the target cell surface) can be administered systematically. Alternatively, in a preferred embodiment, a recombinant DNA construct is utilized in which the antisense oligonucleotide is placed under the control of a strong promoter (e.g., pol III or pol II). The use of such a construct to transfect target cells in the patient results in the transcription of sufficient amounts of single stranded RNAs that will form complementary base pairs with the endogenous NRG1 transcripts and thereby prevent translation of the NRG1 mRNA. For example, a vector can be introduced in vivo such that it is taken up by a cell and directs the transcription of an antisense RNA. Such a vector can remain episomal or become chromosomally integrated, as long as it can be transcribed to produce the desired antisense RNA. Such vectors can be constructed by recombinant DNA technology methods standard in the art and described above. For example, a plasmid, cosmid, YAC or viral vector can be used to prepare the recombinant DNA construct which can be introduced directly into the tissue site. Alternatively, viral vectors can be used which selectively infect the desired tissue, in which case administration may be accomplished by another route (e.g., systematically).

Endogenous NRG1 expression can also be reduced by inactivating or "knocking out" NRG1 or its promoter using targeted homologous recombination (e.g., see Smithies et al. (1985) Nature 317:230-234; Thomas & Capecchi (1987) Cell 51:503-512; Thompson et al. (1989) Cell 5:313-321). For example, a mutant, non-functional NRG1 (or a completely unrelated DNA sequence) flanked by DNA homologous to the endogenous NRG1 (either the coding regions or regulatory regions of NRG1) can be used, with or without a selectable marker and/or a negative selectable marker, to transfect cells that express NRG1 in vivo. Insertion of the DNA construct, via targeted homologous recombination, results in inactivation of NRG1. The recombinant DNA constructs can be directly administered or targeted to the required site in vivo using appropriate vectors, as described above. Alternatively, expression of non-mutant NRG1 can be increased using a similar method: targeted homologous recombination can be used to insert a DNA construct comprising a non-mutant, functional NRG1 (e.g., a gene having SEQ ID NO: 1), or a portion thereof, in place of a mutant NRG1 in the cell, as described above. In another embodiment, targeted homologous recombination can be used to insert a DNA construct comprising a nucleic acid that encodes an NRG1 polypeptide variant that differs from that present in the cell.

Alternatively, endogenous NRG1 expression can be reduced by targeting deoxyribonucleotide sequences complementary to the regulatory region of NRG1 (i.e., the NRG1 promoter and/or enhancers) to form triple helical structures that prevent transcription of NRG1 in target cells in the body. (See generally, Helene, C. (1991) Anticancer Drug Des., 6(6):569-84; Helene, C., et al. (1992) Ann, N.Y. Acad. Sci., 660:27-36; and Maher, L. J. (1992) Bioassays 14(12):807-15). Likewise, the antisense constructs described herein, by antagonizing the normal biological activity of one of the NRG1 proteins, can be used in the manipulation of tissue, e.g. tissue differentiation, both in vivo and for ex vivo tissue cultures. Furthermore, the anti-sense techniques (e.g. microinjection of antisense molecules, or transfection with plasmids whose transcripts are anti-sense with regard to an NRG1 mRNA or gene sequence) can be used to investigate role of NRG1 in developmental events, as well as the normal cellular function of NRG1 in adult tissue. Such techniques can be utilized in cell culture, but can also be used in the creation of transgenic animals.

In yet another embodiment of the invention, other NRG1 therapeutic agents as described herein can also be used in the treatment or prevention of schizophrenia. The therapeutic agents can be delivered in a composition, as described above, or by themselves. They can be administered systemically, or can be targeted to a particular tissue. The therapeutic agents can be produced by a variety of means, including chemical synthesis; recombinant production; in vivo production (e.g., a transgenic animal, such as U.S. Pat. No. 4,873,316 to Meade et al.), for example, and can be isolated using standard means such as those described herein.

A combination of any of the above methods of treatment (e.g., administration of non-mutant NRG1 polypeptide in conjunction with antisense therapy targeting mutant NRG1 mRNA; administration of a first splicing variant encoded by NRG1 in conjunction with antisense therapy targeting a second splicing variant encoded by NRG1), can also be used.

Use of ErbB4 and NRG1 Hypomorph Mice

As described in the Examples below, ErbB4 hypomorphic mice and NRG1-TM hypomorphic mice demonstrate a behavioral phenotype (hyperactivity) that overlaps with the behavioral phenotype of other pharmacological and mutant mouse models of schizophrenia. This behavioral phenotype is reversible with clozapine, an atypical antipsychotic drug. As a result of this discovery, methods are now available to assess agents for neuroleptic activity, and to identify potential therapeutic agents for treatment of schizophrenia, using such hypomorphic mice. The present invention thus also pertains to methods for assessing neuroleptic activity of an agent of interest, as well as methods for identifying potential therapeutic agents for treatment of schizophrenia, comprising administering the agent of interest to a mouse that is hypomorphic for ErbB4 or NRG1. In addition, ErbB4 and NRG1 hypomorphic mice can be used to identify and study phenotypes associated with schizophrenia.

"Neuroleptic" activity, as used herein, refers to the ability of an agent of interest to treat (e.g., control, reduce, or prevent) psychosis or act as an antipsychotic agent: that is, to control or prevent symptoms of psychosis or to treat mental disorders whose manifestations include psychotic symptoms such as hallucinations or delusions.

A "hypomorph," as used herein, refers to a mutant gene (herein referred to as an "affected" gene) having a similar but altered (weaker) effect, compared with the corresponding wild-type gene. A hypomorphic mouse thus has a mutation in the gene of interest (e.g., ErbB4, neuregulin 1) that affects the expression or structure of the protein encoded by the gene, and thereby affects the activity of the protein encoded by the gene. Such mutations can include null alleles or knockouts. The hypomorphic mouse can be heterozygous for the mutation, or homozygous. A "wild type" mouse, as used herein, refers to a mouse that is wild type for the gene that is affected in the hypomorphic mouse. In one embodiment, the hypomorphic mouse has a mutation in the ErbB4 gene. In another embodiment, the hypomorphic mouse has a mutation in the neuregulin gene. In a preferred embodiment, the hyopmorphic mouse has a mutation in the transmembrane (TM) region of the neuregulin gene. A hypomorphic mouse can be generated using techniques such as those described above in relation to transgenic mice.

In the methods of the invention, the behavior of the hypomorphic mice is assessed. Hypomorphic mice described herein (e.g., ErbB4 hypomorphs, neuregulin 1 hypomorphs) demonstrate abnormal behavior, compared with the behavior of wild-type mice. The term, "abnormal behavior," as used herein, refers to behavior which statistically differs from wild-type animals which are similarly treated. Abnormal behavior can include a variety of standard behaviors which can be objectively measured and statistically compared, including ataxia, rapid limb movement, eye movement, breathing, motor activity, cognition, emotional behaviors and social behaviors. In a preferred embodiment, the abnormal behaviors correlate with schizophrenic behaviors in humans, such as hyperactivity and abnormal social interaction.

Behaviors of the mice can be assessed using standard tests well-known by those skilled in the art. In preferred embodiments, behaviors that are assessed include hyperactivity, social interaction, and pre-pulse inhibition. Representative tests of rodent behavior are described below. For additional description of such tests as well as other representative tests of rodent behavior, see, for example, U.S. Pat. No. 5,549,884, the teachings of which are incorporated by reference herein in their entirety.

For a swim test, the animal is immersed in water for a set period of time and locomotor activity (e.g., distance traveled) is assessed. Locomotor activity can be measured by direct observation and/or through the use of automatic photocell monitor. For an isolation test, the animal is housed in a cage without any sensory contact and abnormal behaviors are measured in terms of activity (e.g., distance traveled), learning (e.g., number of correct responses when placed in a maze), and emotionality (e.g., aggressiveness). For a social interaction test, the animal is exposed to other animals in a variety of settings and subsequent social behaviors (e.g., touching, climbing, sniffing and mating) are assessed. For a pre-pulse inhibition of startle response test, the animal is exposed to a sensory stimulus, and the startle responses of the animal to similar acoustic or tactile stimuli are measured. For a novelty test, the animal is exposed a novel environment and/or novel objects, and the animal's behavior (e.g., motor behavior) in the novel environment and/or around the novel object are assessed. For a stimulant-induced hyperactivity test, stimulant drugs (e.g., amphetamines, cocaine, PCP, etc.), are administered to the animal, and behavior (e.g., motor activity, social interactions, cognitive behavior) is assessed. For a spatial learning test, the animal is exposed to a complex novel environment, and the rapidity and extent of spatial learning is assessed. For an open field test, the animal is exposed to a variety of test arenas under low lighting conditions, and the activity of the animal (e.g., locomotion, total distance traveled, rearing, number of center entries, and percent time spent in the center area and periphery of the test arena) is assessed. In a preferred embodiment, an open field test is used.

Statistical analysis of the various behaviors measured can be carried out using any standard statistical programs routinely used by those skilled in the art (such as, for example, ANOVA). Generally, a P value less than 0.05, i.e., P<0.05, is considered to be statistically significant. To analyze abnormal behavior, a comparison is made between the behavior of a hypomorphic mammal and the behavior of a wild-type animal.

In one embodiment of the methods of the invention, an agent of interest is administered to an ErbB4 or neuregulin 1 hypomorphic mouse. An "agent of interest," as the term is used herein, refers to an agent to be assessed for neuroleptic activity. Representative agents include known neuroleptic agents (e.g., "typical" neuroleptics, such as promazine, triflurpromazine, chlorpramazine, chlorprothixene, thioridazine, mesoridazine, droperidol, acetophenazine, loxapine, molindone, perphenazine, prochlorperazine, thiothixens, trifluoperazine, fluphenazine, halperidol, pimozide, flupenthixol, methotrimeprazine, pipotiazine; and "atypical" neuroleptics, such as clozapine, risperidone, olanzapine, quetiapine, sertindone, ziprasidone, iloperidone), as well as other agents whose neuroleptic activity is not yet known.

In another embodiment of the methods of the invention, an agent of interest is administered to assess whether it is a potential therapeutic agent for the treatment of schizophrenia. A "potential therapeutic agent," as that term is used herein, refers to an agent that may have therapeutic value for the treatment of schizophrenia: that is, the agent may control, reduce, or prevent manifestations of schizophrenia that include hallucinations or delusions. Administration of an agent (clozapine) that is used to treat schizophrenia, to ErbB4 hypomorphic mice and to neuregulin 1 hypomorphic mice, reduces an abnormal behavior (hyperactivity) that is associated with schizophrenia phenotype in humans. Thus, it is anticipated that other agents that similarly reduce the abnormal behavior in ErbB4 hypomorphic mice and to neuregulin 1 hypomorphic mice will likewise be useful to treat schizophrenia.

The behavior of the hypomorphic mouse is then assessed, and compared with the behavior of a hypomorphic mouse that has not been administered the agent of interest. A decrease in abnormal behavior, by an amount that is statistically significant, in the hypomorphic mouse that has been administered the agent of interest, is indicative of neuroleptic activity of the agent of interest, or is indicative that the agent is a potential therapeutic agent.

In another embodiment of the invention, ErbB4 and NRG1 hypomorphic mice can be used to identify and study phenotypes associated with schizophrenia. Because the NRG1-TM hypomorphic mouse and the ErbB4 hypomorphic mouse, as described herein, demonstrated abnormal behavior (hyperactivity) that is associated with schizophrenia phenotype in humans, and that is reduced by administration of an agent that is used to treat schizophrenia, other NRG1 hypomorphic mice and ErbB4 hypomorphic mice (those having different mutations in the NRG1 gene or the ErbB4 gene) are likely to demonstrate other abnormal behaviors similarly associated with schizophrenia phenotype that can similarly be reduced by administration of an agent that is used to treat schizophrenia.

The invention will be further described by the following non-limiting examples. The teachings of all publications cited herein are incorporated herein by reference in their entirety.

EXEMPLIFICATION

Example 1

Identification of Gene with Linkage to Schizophrenia

Patient Population

The lifetime expectancy of schizophrenia in Iceland is similar to what has been observed in the neighboring countries, 0.6% for males and 0.9% for females. A team of seven psychiatrists who diagnose patients and confirm the diagnosis of previously diagnosed schizophrenics and collect samples was employed. Each psychiatrist interviewed, using the Schedule for Schizophrenia and Affective Disorders, lifetime version (SADS-L) (Endicott, J. and Spitzer, R. L., *Arch. Gen. Psychiatry* 35:837 (1978)). The information from the SADS-L interviews was then used to classify all cases in accordance with research diagnostic criteria (RDC) and the Diagnosis and Statistical Manual of Mental Disorders, third edition, revised (DMS III-R). Furthermore, the operational criteria OPCRIT checklist for psychotic illness was also used to facilitate a polydiagnostic approach to psychotic illness (McGuffin, P. et al., *Arch. Gen Psychiatry* 48(8):764-70 (1991)).

Construction of a BAC Contig

A BAC (bacterial artificial chromosome) contig for the region of interest was generated using the RCPI-11 Human BAC library (Pieter dejong, Roswell Park). BACs were identified by hybridization using available STS markers and microsatellite markers in the region, followed by successive rounds of hybridization using markers designed from BAC end sequences. Hybridization results were confirmed and the order of the BACs determined by PCR using all available markers in the region. BAC fingerprint data complemented these data. Fingerprints of positive clones (FPCs) were analysed using the FPC database developed at the Wellcome Trust Sanger Institute. New microsatellite markers were discovered from cloning and screening fragments from nebulized BACs. The primary goal was to achieve a high resolution ordering of the microsatellite markers.

Search for New Microsatellite Markers

BACs were shotgun cloned and gridded onto membranes. Clones containing microsatellite repeats were identified by hybridization with oligonucleotide probes consisting of microsatellite repeat sequences. Positive clones were analyzed by sequencing and primers designed to amplify the microsatellites.

DNA Sequencing

Nine BACs, covering the minimum tiling path of the region of interest, were analyzed by shotgun cloning and sequencing. Dye terminator (ABI PRISM BigDye™) chemistry was used for fluorescent automated DNA sequencing. ABI prism 377 sequencers were used to collect data and the Phred/Phrap/Consed software package in combination with the Polyphred software were used to assemble sequences.

Search for Exons in Sequence Databases

Exons/genes were searched for by BLAST alignment to DNA and protein databases.

Search for New Exons in cDNA Libraries

We identified syntenic mouse BACs (20) (library RPCI-23) and by BAC walking a contig across the NRG1 locus was made. The methods described above were used to subclone and sequence 8 syntenic BAC clones from the mouse. The mouse sequence was used to identify more exons and potential regulatory elements. Both 3' and 5' RACE (rapid amplification of cDNA ends) were carried out using the Marathon-Ready™ cDNA from Clontech laboratories Inc. and cDNA libraries made at deCODE genetics. cDNA libraries from whole brain, fetal brain and testis were used.

Search for New Exons Using Exon Prediction Tools

Gene miner software (deCODE genetics) was used to predict where exons were in our 1.5 Mb sequence. Primers for amplifying these candidate exons from cDNA libraries were designed, touch down PCRs were carried out, and the products were verified by sequencing. Exon sequences and sequences 2 kb upstream of each transcription start site from 184 patients were analysed for SNP detection. Conserved regions mouse:human (potential regulatory elements) showing 80% identity over 100 bp and longer were screened in 94 patients. SNPs were scored using a fluorescent based method (Chen, et al., *Genome Res.* 9, 492 (1999)).

Trapping Exons

Exons were "trapped" by using the Exon trapping kit from Live technologies. Primers were designed for amplifying these candidate exons from cDNA libraries, touch down PCRs were carried out, and the products were verified by sequencing.

Genome-Wide Scan

Samples from affected individuals related within 6 meiotic events, 260 affected individuals and 334 associated relatives, have been genotyped using a marker set of 950 microsatellite markers. One locus, 8p21-8p11, was reexamined with additional 150 follow-up markers. In addition to the 260 affected individuals and their relatives in the genome wide scan, 132 affected individuals and 147 available relatives were also genotyped using the 150 microsatellite markers for the 8p21-p12 locus.

Statistical Analysis

A linkage analysis was performed with the Allegro software. FIG. 1 displays the results for the Allele-Sharing Model using the CS affected pedigree (158 affected individuals, maximum distance of 5 meiotic events between affected individuals).

Physical Mapping of the Probable Schizophrenic Locus (Locus on 8p21-p12)

The most significant locus that was found, with a maximum LOD score near 3, was physically mapped using bacterial artificial chromosomes (BACs). Initially the locus was wide, around 30 cM. Only a small fraction of this region had been sequenced previously, with the total cumulative number of bases of around 5 Mb. The published order of markers in the region was not correct and most of the polymorphic markers known in this region had not been radiation hybrid mapped. The primary goal with the BAC map was to achieve a high-resolution ordering (100 to 150 kb) of all polymorphic markers in this region and search for new polymorphic markers By screening BAC libraries with primers from the region, 3000 BACs were retrieved by hybridization and PCR methods. Contig mapping was performed; 940 of these clones were assigned by PCR and hybridization to contigs. In addition, 252 additional BACs were assigned to contigs based on fingerprint analysis (a total of 1192 BAC clones have been assigned to contigs). After correcting the marker order the maximum lod score is 3.1 (FIG. 1). The order of 534 markers in the 30 cM BAC area covered by the BAC contig has now been determined. The physical map has allowed the ordering and placement of polymorphic microsatellite markers and STS markers. BACs were subcloned from the BAC contig and searched for new microsatellites by hybridization. Samples were genotyped using, on average, a polymorphic microsatellite marker every 0.17 cM throughout the locus. Microsatellites are set forth in Tables 2 and 3.

As a result of the physical mapping effort the locus was narrowed to approximately 20 cM. This 20 cM region was spanned by four big contigs, 2-10 Mb each. The main peak extended over 7 cM and this region resided in one BAC contig. The four contigs were correctly ordered based on data from radiation hybrid mapped markers in these contigs, yeast artificial chromosomes (YAC) maps and by comparing haplotypes within families. Now that the marker order has been corrected, as described herein, the densely mapped markers can be used to reconstruct more correct haplotypes and search for at-risk haplotypes giving substantial overlap between families.

Identification of at-Risk Haplotypes

Locus 8p21-p12

Figure 2E:
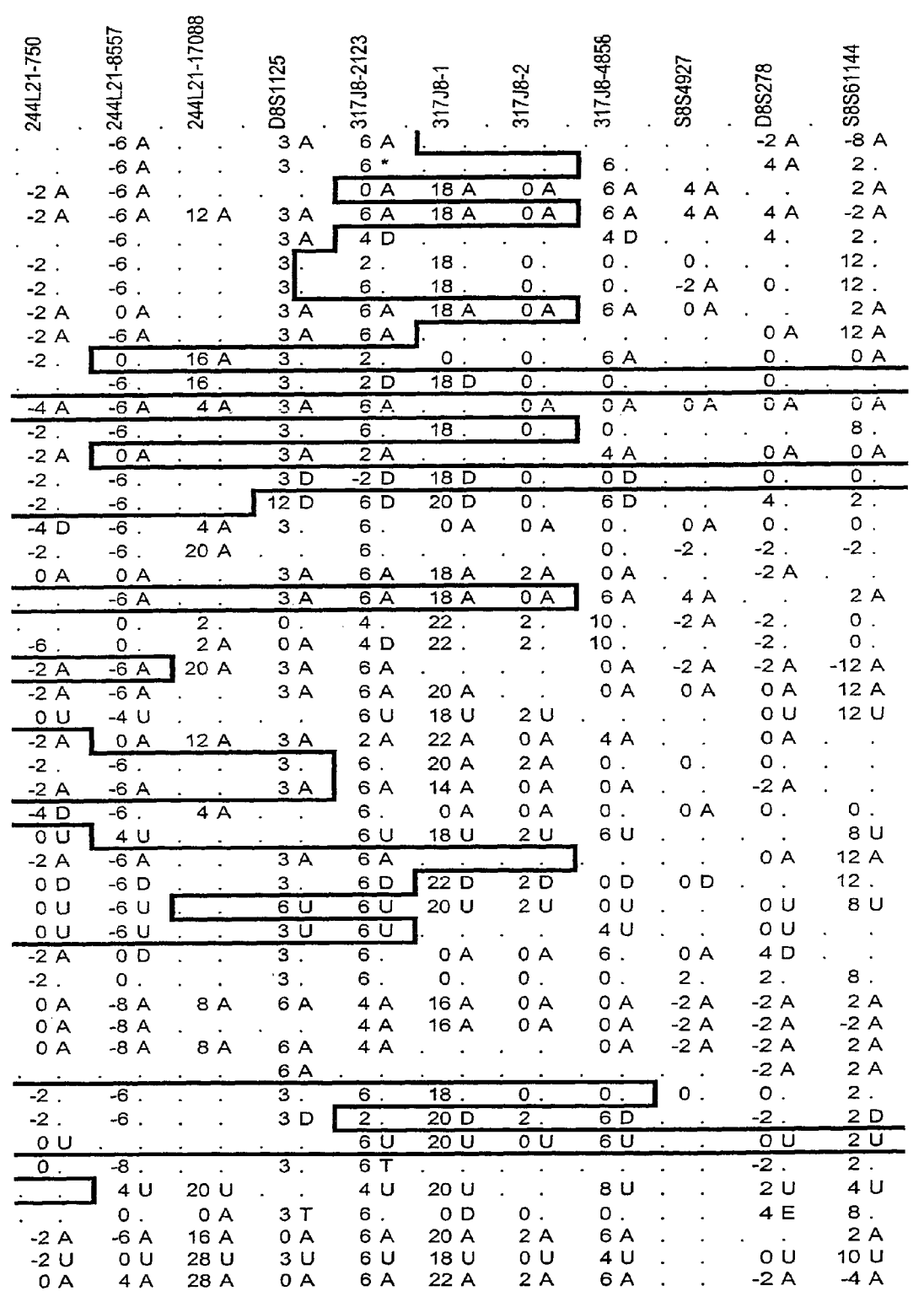
Figure 3:
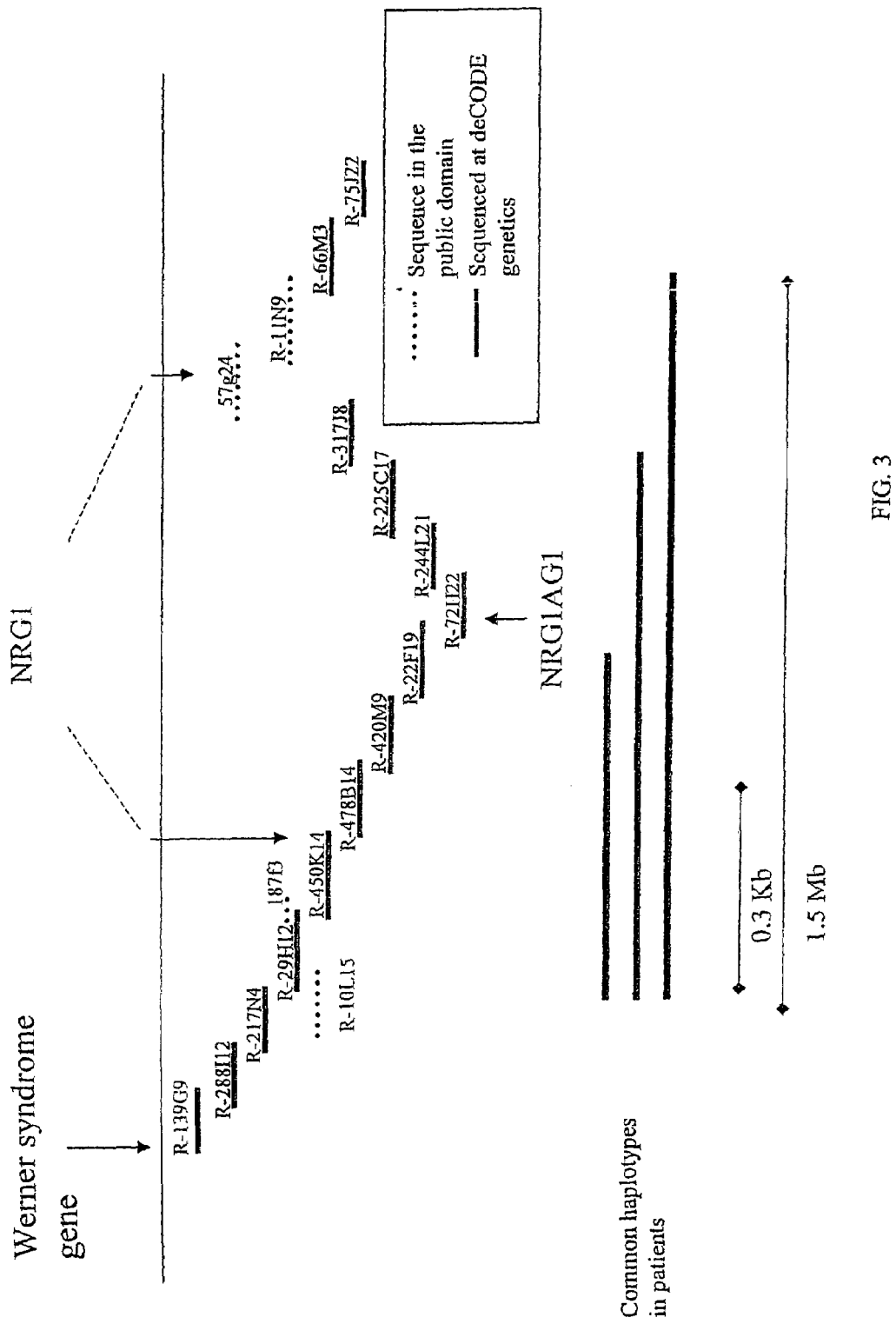
FIG. 3 depicts the order of sequenced BACS and boundaries for at-risk haplotypes for schizophrenia at locus 8p12.

Using genotypes for the densely mapped markers, haplotypes of the affected individuals were constructed, and candidate at-risk haplotypes which are carried by three or more affected individuals within each individual family were identified. By comparing these candidate haplotypes across families, it was found that some of these haplotypes have substantial overlap (FIG. 2). The core of the haplotype found in affected individuals (6 markers telomeric to D8S1810, 0.3 Mb) was found in 10% of the patients (37 out of 746 chromosomes investigated). In comparison, 3% of controls had this haplotype (6 out of 376). FIG. 2 shows 44 patient haplotypes having a part of this at-risk haplotype. FIG. 3 shows an overview of the order of sequenced BACS and the boundaries for the at-risk haplotypes at locus 8p12.

The results from the linkage and haplotype analyses strongly suggested the presence of a disease-susceptibility gene residing in a 1.5 Mb segment at 8p12, harboring exons from the gene, neuregulin 1 (NRG1) and from a new gene, neuregulin-1-associated gene 1 (NRG1AG1). The gene for neuregulin 1-associated gene 1 (NRG1AG1) is described further in U.S. patent application Ser. Nos. 09/515,715 and 09/795,686, entitled "Human Schizophrenia Gene," and incorporated herein by reference in their entirety.

The Sequence of the Candidate Region

Locus 8p12

Sequencing of 1.5 Mb of the BAC contig on 8p12 where candidate haplotypes showed substantial overlap between families. This sequence was in one contig and harbors a very interesting candidate gene, Neuregulin 1 (NRG1).

Gene Identification

Locus 8p12

Neuregulin 1 is a well characterized gene from which many splice forms have been investigated. A depiction of the exons, single nucleotide polymorphisms (SNPs), and exons is presented in FIG. 4. New exons and splice variants for Neuregulin 1 have been identified by screening cDNA libraries. The gene and its splice variants are shown in the sequence listing and Table 1.

Neuregulin 1 associated gene 1 is a new gene and known protein sequences do not show significant homology to this new gene. A depiction of the exons, single nucleotide polymorphisms (SNPs), and deletions and insertions is presented in Tables 2 and 3. Since this gene is within the Neuregulin gene and located within the 1.5 Mb region defined by the at-risk haplotypes, it is also a strong candidate gene for schizophrenia.

We have screened all known and novel exons of NRG1 (N=28) and EST cluster Hs.97362 (N=8) and identified 15 non-synonymous SNPs for NRG1 and 3 in the EST cluster Hs.97362. We have identified 2 synonymous SNPs and 7 SNPs in the untranslated part of NRG1 and 1 synonymous SNP and 4 SNPs in untranslated regions of EST cluster Hs.97362. A total of more than 1200 SNPs have been identified in the entire NRG1 sequence. All coding SNPs and a number of SNPs in promoter regions were genotyped for 394 unrelated controls and 478 patients. Furthermore, a number of SNPs identified in conserved regions were also scored. A total of 58 SNPs were genotyped for all patients and in a subset of patients (N=94) and controls (N=124) an additional 123 SNPs were scored for association. A few SNP alleles showed mild but significant single marker associations but they do not change amino acids or splice sites.

While no single SNP or microsatellite gave significant excess in the patients (after accounting for multiple testing), a core haplotype consisting of 5 SNPs and 2 microsatellite markers was identified (P value between $6.7 \times 10^{-6}$* and $8.7 \times 10^{-5}$) (FIG. 6). This core covers 290 kb and represents a block of linkage disequilibrium. Close to 90% of this core haplotype can be accounted for by four extended haplotypes involving 16 markers (FIG. 6). Interestingly, while HapA in FIG. 6 corresponds to the extended microsatellite haplotype I in FIG. 5 identified in the linkage families, HapB and HapC (1 and 2), apart from having common alleles for microsatellite markers 478B14-848 and 420M9-1395, tend to have different alleles for many of the microsatellite markers (not all shown in FIG. 6). Indeed, at various intermediate stages before we realized they share a core, HapA, HapB and HapC (1 and 2) were each considered as independent at-risk haplotypes showing significant excess in the patients relative to the controls (FIG. 6). The estimates of their risks relative to the wild type are also comparable or around two for HapA and HapB, higher for HapC but the estimate for HapC is based on small numbers (FIG. 6). Hence we believe that this core haplotype is capturing an ancestral at-risk haplotype that is represented by a number of extended microsatellite/SNP haplotypes in the current population. FIG. 6 shows the likely locations of historic recombination breakpoints and also reveals that the microsatellite marker D8S1810 has probably mutated since the at-risk SNP haplotype was formed. Haplotypes derived using information from relatives of patients and controls agreed with these haplotypes derived using the likelihood approach.

The core at-risk haplotype has estimated frequency of 7.5% in the general population and 15.4% among all schizophrenia patients. Assuming a multiplicative model, individuals are estimated to have 2.2 times the risk relative to the wild type for each at-risk haplotype evaluated. To supplement the results from the case-control study, we performed the transmission disequilibrium test (TDT was performed for probands where both parents are genotyped and one or both are heterozygous for the at-risk haplotype (Spielman, et al., *Am. J. Hum. Genet.* 52, 506 (1993)) and found that for parents who were heterozygous with respect to the core haplotype, there were 33 transmissions to the affected offsprings and 17 non-transmissions (P=0.016). While these results are only marginally significant due to the small sample size (parents were not available for genotyping in many cases), it is heartening that the ratio of transmissions to non-transmissions is close to 2:1 which is consistent with the estimated relative risk of 2.2 based on the case-control data.

It is worth noting that the region of interest exhibits extensive linkage disequilibrium. The core haplotype of 7 markers can be identified by only 3 markers, one SNP and two microsatellites. Specifically, if a haplotype includes alleles 1, 0 and 0 respectively for SNP8NRG221533, 478B14-848 and 420M9-1395, then there is little uncertainty that it has the corresponding alleles for the other 4 markers. Moreover, each of HapA, HapB and HapC in FIG. 6 can be captured by only 5 markers, the three identifying the core plus microsatellite markers 29H12-121L21 and D8S1810. Also, HapA is a good surrogate for the extended microsatellite haplotype I in FIG. 5. The core at-risk haplotype does not overlap with EST cluster Hs.97362 suggesting that NRG1 is the more likely candidate gene in this region. None of the SNPs in the core haplotype is likely to be the causative SNP since no one SNP captures the same degree of association as the core haplotype, they are, therefore, more likely in linkage disequilibrium with the causative allele.

Microsatellite haplotype II (FIG. 5) was found in substantially higher frequency in patients from the linkage families than in controls (data not shown). The markers identifying this haplotype overlap with those of the core haplotype shown in FIG. 6, but the alleles are different. This haplotype is rare in controls and in the patients who were not used in the linkage analysis.

Based on the estimated frequencies and relative risks reported above, the core haplotype has a population attributed risk of 16%. It accounts for a 9% increase in risk for siblings of an affected individual. Hence its contribution to the familial risk of schizophrenia, which has been reported to have λs close to 8.6 (N. Risch, *Am. J. Hum. Genet.* 46, 222 (1990)), is small and cannot fully explain the linkage results we and others obtain for this region. While part of the reason could be that there are other schizophrenia susceptibility genes in the 8p region contributing to the lod scores and results from linkage analyses have the tendency to over-estimate the contribution of the gene, we believe there must be other at-risk alleles/haplotypes of NRG1, probably rarer but possibly with higher penetrance, yet to be found (e.g., microsatellite haplotype II). In addition, a high mutation rate in this gene, may account for the disparity between linkage and associated haplotypes.

Neuregulin 1 (NRG1)

Neuregulin 1 (also called ARIA, GGF2 and heregulin) are a group of polypeptide factors that arise from alternative RNA splicing of a single gene (Fischbach, G. D. and Rosen, K. M., *Annu. Rev. Neurosci.* 20:429-458 (1997); Orr-Urtreger, A., et al., *Proc. Natl. Acad. Sci. USA* 90:1746-1750 (1993); see also, Corfas, G. et al., *Neuron* 14(1): 103-15 (1995) and Meyer, D. et al., *Development* 124(18):3575-86 (1997)). The basic structure of neuregulin 1 includes a N-terminal region, an immunoglobulin (Ig) motif, a glycosylation-rich spacer domain, an EGF-like domain, and a cytoplasmic tail (see (Fischbach, G. D. and Rosen, K. M., *Annu. Rev. Neurosci.* 20:429-458 (1997); Loeb, J. A. et al., *Development* 126(4): 781-91 (1999); and Meyer, D. et al., *Development* 124(18): 3575-86 (1997)). The entire gene sequence of neuregulin 1, depicted herein for the first time, is shown as SEQ ID NO: 1. Splicing variants result in a variety of polypeptide sequences, for example, those sequences having SEQ ID NO: 2 through SEQ ID NO: 5 and SEQ ID NO: 10 through SEQ ID NO: 38, inclusive. Table 4 sets forth a table of splice variants. Table 4 includes eight new variants which were found by screening cDNA libraries. One of the clones which was found, clone OG-49-2 (see Table 4) is different from the previously known clones. It has a known N-terminal region, a kringle like domain, and then an ALU exon at the 3' end. This clone does not have the EGF like domain as all previously known Neuregulin clones.

Neuregulin is expressed in many tissues, among others in the central nervous system (see, e.g., Corfas, G. et al., *Neuron* 14(1):103-115 (1995)). Neuregulin 1 gene is expected to be associated with schizophrenia for many reasons, including its role in the expression of the N-methyl-D-aspartate (NMDA) receptor, in activation of AChR gene expression as well as activation of epidermal growth factor receptors and GABA(a) receptor subunits, and also its induction of components in a G-protein signaling cascade. Each of these activities of neuregulin 1 is discussed briefly below.

Neuregulin is involved in the expression of the NMDA receptor subunits (Mohn, A. R. et al. *Cell* 98(4):427-36 (1999)). The NMDA receptor is made up of an NR1 subunit and selection of developmentally and regionally regulated NR2 subunits (A to D). Genetically engineered mutant (mice) expressing only 5% of the normal number of NR1 subunits display schizophrenic features and are probably the best rodent model of schizophrenia so far (id.).

Neuregulin is a potent activator of AChR gene expression. The neural signals proposed to induce the mRNA expression of acetylcholine receptors in muscle include neuregulin (NRG). Neuregulin increases AChr expression by binding and activating erbB receptor tyrosine kinases, including the recruitment of the SH2 domain protein SCH, and subsequently activating the Ras/Raf, MAPK cascade (Lindstrom, J., *Mol. Neurobiol.* 15(2):193-222 (1997)). Pathogenic roles of AChRs are being discovered in many diseases involving mechanisms ranging from mutations, to autoimmune responses, and involving signs and symptoms ranging from muscle weakness to epilepsy, to neurodegenerative disease, to psychiatric disease, to nicotine addiction (id.). A dopamine hypothesis of schizophrenia suggests that it is caused by excess dopamine. Some similar symptoms can be caused by drugs like PCB that act as channel blockers for glutamate receptors and AchRs. A high proportion of schizophrenics are intense tobacco users. It has been suggested that they may be attempting to self medicate. Mutation in the neuregulin gene may alter the expression of the AchR gene and through that mechanism cause the disease.

One important function of neuregulin is interaction with the ErbB family of receptors to assist in regulating cell growth and differentiation. For example, neuregulin activates the epidermal growth factor receptors ErbB3 and ErbB4 (Zhu, X. et al., *EMBO J.* 14(23):5842-8 (1995); Kornblum, H I et al., *Dev. Neurosci.* 22(1-2):15-24 (2000)). Expression of NRG1 and the ErbB receptors in the developing nervous system is indicative of their role in neural development, including the regulation of cell fate specification, proliferation and survival in the neural crest lineage. Recent evidence indicates that ErbB3 and ErbB4 play an important role in the development of the CNS. Some theories on the causes of schizophrenia postulate that the disease is caused by defective brain development and there are studies that support the presence of neuro developmental abnormalities in schizophrenia (Kornblum, H. I. et al., *Dev. Neurosci.* 22(1-2):16-24 (2000)).

Neuregulin induces the expression of the GABA(A) receptor beta2 subunit. This increase in subunit expression is paralleled by an increase in functional GABA(A) receptors (Rieff, H. I. et al., *J. Neurosci.* 19(24):10757-66 (1999)). One hypothesis is that the pathophysiology of schizophrenia may be associated with a dysfunction in GABA transmission in the human prefrontal cortex. Dysfunction of the dorsolateral prefrontal cortex appears to be a central feature of the pathophysiology of schizophrenia, and this dysfunction may be related to alterations in gamma aminobutyric acid (GABA) neurotransmission (id.).

Activation of the NRG signaling pathway can induce the expression of components in a G-protein signaling cascade (Fu, A. K et al., *Mol. Cell Neurosci.* 14(3):241-53 (2000)). Metabotropic glutamate receptors have received considerable attention over the past decade in view of their relevance in multiple aspects of glutamatergic transmission. Recent advances in the molecular biology, pharmacology and medicinal chemistry of this family of G-protein-coupled receptors have led to therapeutic opportunities for subtype-selective modulators in brain disorders and diseases such as ischemia and schizophrenia (Richardson-Burns, S. M. et al., *Biol. Psychiatry* 47(1):22-8 (2000)).

The gene was identified by predicting where exons might be located in the 1.5 Mb sequence defined by the at-risk haplotypes. Primers were then designed, and cDNA libraries (Brain) were screened.

Mutation Analysis

Neuregulin (8p12)

Figure 4:
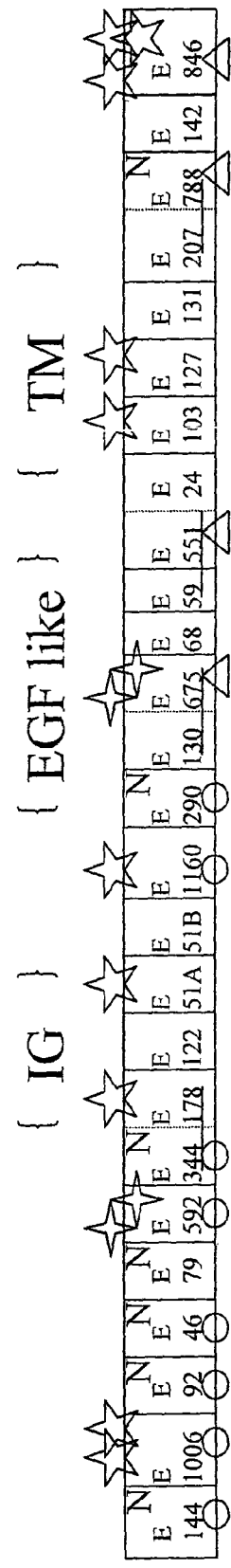
FIG. 4 depicts the exons, single nucleotide polymorphisms (SNPs), and exons of neuregulin 1 at locus 8p12. Cylinders, screened for mutations; N, new exons; open stars, SNPs (coding); filled stars, SNPs (untranslated); open circles, 5' exons; filled circles, 3' exons; lines, genomic neighbors.

A number of SNPs have been found in exons, including four SNPs that change an amino acid in the protein, and four SNPs that have been detected in the 5' and 3' untranslated regions (FIG. 4; see also Table 2). SNPs in the introns are being investigated. Several hundred SNPs have been detected in the 1.5 Mb region identified by the candidate at-risk haplotypes. SNPs, deletions and insertions are shown in Tables 2 and 3.

Bacterial Artificial Clones (BACs)

The BAC clones R-217N4, R-29H12, R-450K14, R-478B14, R-420M9, R-22F19, R-72H22, R-244L21, R-225C17, R-317J8 and R-541C15 are from the RCPI-11 Human BAC library (Pieter deJong, Roswell Park). The vector used was pBACe3.6. The clones were picked into a 94 well microtiter plate containing LB/chloramphenicol (25 µg/ml)/glycerol (7.5%) and stored at −80° C. after a single colony has been positively identified through sequencing. The clones can then be streaked out on a LB agar plate with the appropriate antibiotic, chloramphenicol (25 µg/ml)/sucrose (5%).

cDNA Clones—Novel Splice Variants for Neuregulin 1

PCR-RACE products (neuregulin 1) were ligated into the pCRII-TOPO vector (Invitrogen). The cDNA clones are ACF-6_30_8848, OG-49-2, OG-A1R-75, ACF-68, ACF-69, ACF-6_29_8848, ACF-6_28_8847 and ACF-2_11_8847. The clones were picked into a 94 well microtiter plate containing LB/ampicillin (100 µg/ml)/glycerol (15%) and stored at −80° C. after a single colony has been positively identified through sequencing. The clones can then be streaked out on a LB agar plate with the appropriate antibiotic, ampicillin (100 µg/ml) or kanamycin (50 µg/ml).

Example 2

Behavioral Testing of NRG1 and ErbB4 Mutant Mice

Male NRG1TM hypomorphs, ErbB4 hypomorphs and litter-mate controls for each line were bred at Charles River Laboratories USA by crossing to a C57B16 background. They were shipped to the testing laboratory at PsychoGenics Inc. NY, USA (six weeks prior to behavioral testing) where they were housed in groups of 3-5 related mice per cage. The open field study was conducted when the male mice were 5 to 6 months of age. Group housed mice were brought into the experimental room and allowed to acclimate for one hour prior to testing. Each mouse was placed for 30 minutes in a square open field box (17×17×12 inch). Up to eight animals were tested at one time, one animal in each of eight arenas, under low lighting conditions (provided by a 15 watt red lamp). The automated infrared beam array system measured locomotion in the center and periphery of the test arena. Activity data were collected in 5 min intervals over the 30 min open field session and analyzed with a series of repeated measures analysis of variance (ANOVA) with session interval as a within-subject factor and genotype as a between-subject factor. Clozapine (1 mg/kg in 1% Tween 20, pH 6.0) was injected intraperitoneally (i.p.) 25 min before behavioral testing. Total activity data from the study with clozapine were analyzed with a two-tailed, Student's t-test. Naïve mice were used for these experiments. It seemed that handling the mice or habituation to the testing conditions changed the level of hyperactivity or the sensitivity to clozapine on repeated test.

Binding Studies

[$^3$H]-dizocilpine (MK-801) binding in NRG1 hypomorphic mice and control mice was studied as follows: Wild-type (n=18) and NRG1 mutant mice (n=16) forebrains were homogenized individually at 4° C. in 25 volumes of Tris-HCl 50 mM, EDTA 10 mM, pH 7.1 buffer with a polytron (10,000 rpm, 30 sec). The homogenate was centrifuged at 48,000 g for 10 min and the pellet was re-homogenized as above and incubated for 10 min at 37° C. After centrifugation the pellet was homogenized as above and the homogenate frozen at −80° C. [$^3$H]-dizocilpine saturation isotherms were obtained by incubating various amounts of the radioligand (0.1 to 100 nM, final concentration) in the presence of 10 mg brain membranes for 2 hours at room temperature in a Tris-HCl 5 mM, glycine 100 µM, glutamate 100 µM, pH 7.4 binding buffer. The non-specific binding was measured in the presence of 100 µM of 1-[1-(2-Thienyl)cyclohexyl]piperidine (TCP). After incubation the membranes were filtered on GF/B glass fiber filters preincubated for 1 hour in a polyethylenimine 0.1% solution. The filters were washed three times with 3 ml of cold binding buffer and the radioactivity bound to the membranes was measured by liquid scintillation counting. The binding parameters $K_D$ and $B_{max}$ were obtained from the fit to the data of the equation of a rectangular hyperbola (one site model) by non-linear regression and were analysed by ANOVA.

NRG1 and ErbB4 Mutant Mice Display Behavioral Abnormalities that Overlap with Those Observed in Pharmacologically Induced Animal Models of Schizophrenia NRG1 homozygous mice with disrupted EGF domain common to all NRG1 isoforms die embryonically. Heterozygous NRG1 null mice are viable, perform normally in tests of motor function, but show increased open field locomotor activity. An increase in open field locomotor activity is seen in neurodevelopmental models of schizophrenia as well as in several transgenic or knockout mice thought to model aspects of the schizophrenic phenotype.

NRG1 plays a critical role in the central nervous system (CNS) and its major receptors in CNS neurons are ErbB3 and ErbB4. Mice hypomorphic for either NRG1, ErbB2, ErbB3, or ErbB4 have been generated by others. Increased open field activity has been reported for NRG1 hypomorphic mice carrying a null allele, while the ErbB2 and ErbB3 mutant mice have been reported to be behaviorally normal (R. Gerlai, P. Pisacane, S. Erickson, *Behav. Brain Res.* 109, 219 (2000)). Behavioral tests on ErbB4 mice have not been reported.

Figure 7B:
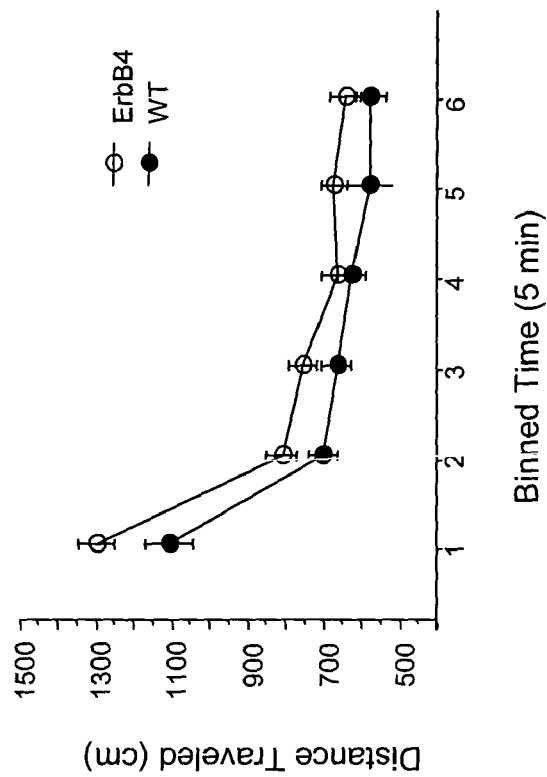
FIGS. 7A and 7B are graphs showing that NRG1TM and ErbB4 hypomorphic mice were significantly more active according to different measures that reflect locomotion and exploration. Here we show distance traveled in an open field test for the two lines of mice.
Figure 7A:
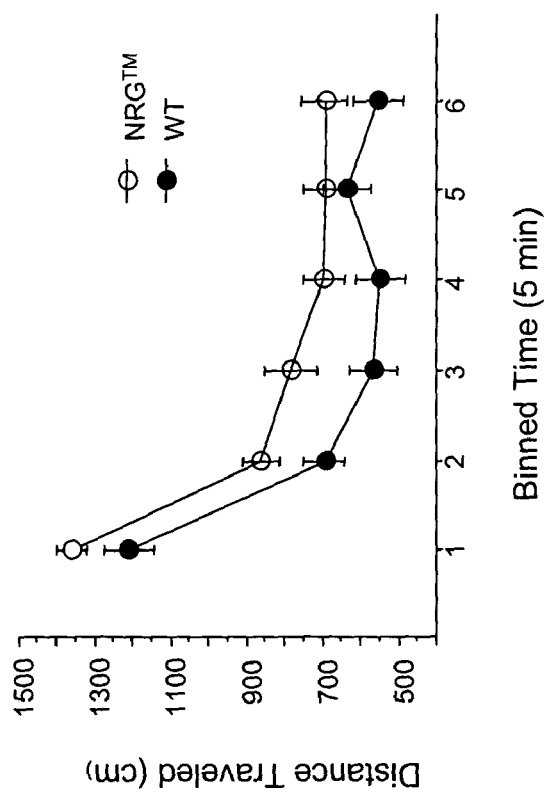

We obtained one line of NRG1 hypomorphic mice (NRG1TM) in which the NRG1 exon encoding the transmembrane domain (TM) is disrupted in the heterozygotes. We also obtained for behavioral testing a line of ErbB4 hypomorphs heterozygous for a null allele of the gene (M. Gassmann et al., *Nature* 378, 390 (1995)). Both lines of mice developed normally, bred well, and showed grossly normal behavior. In the "novel open field-test" performed under dim red light, both the NRG1TM hypomorphs and the ErbB4 hypomorphic mice were significantly more active than the wild type mice (FIGS. 7A and 7B) but did not differ in measures of anxiety such as time in the center of the arena.

Figure 8:
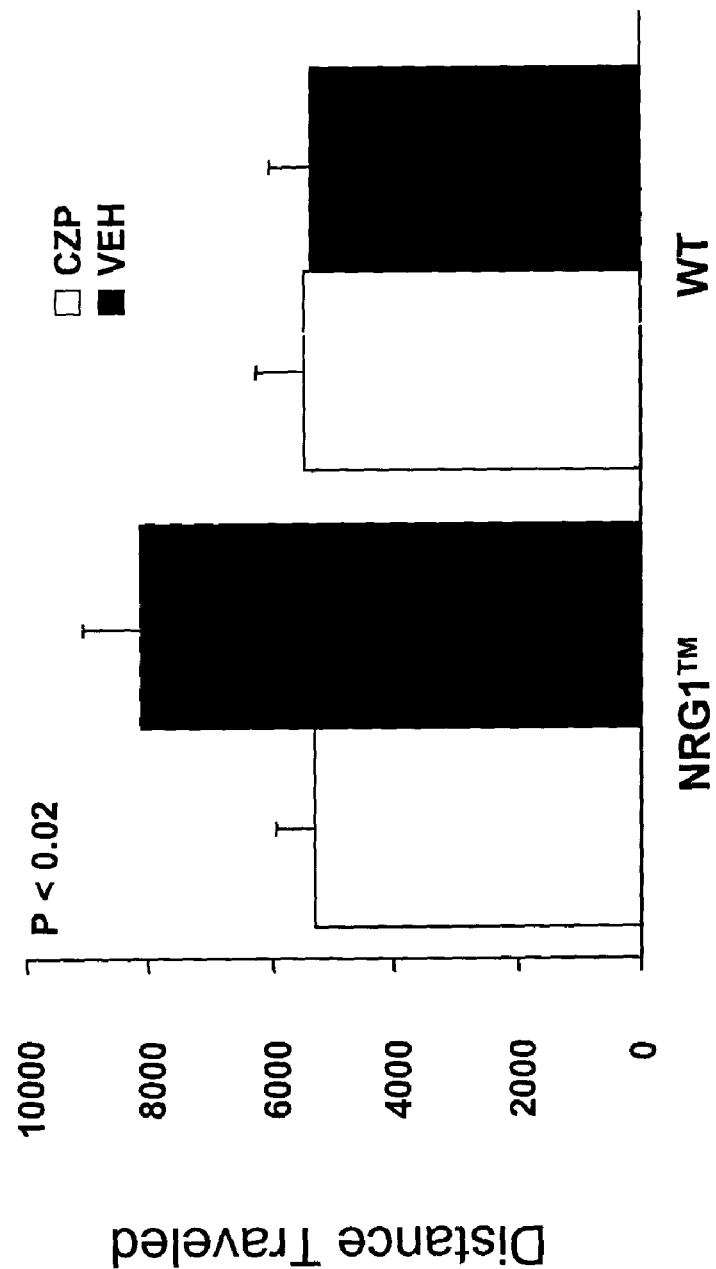
FIG. 8 shows increased locomotor activity in the NRG1TM mice that partly mimics the PCP induced phenotype in mice was ameliorated by clozapine. The NRG1TM mice and litter-mate controls were injected i.p. with either clozapine (1 mg/kg) or vehicle 25 min prior to testing (N=10 NRG1TM mice and 10 controls, P=0.018). Open field activity was monitored. Error bars indicate the standard error of the mean (±SEM).

Ten NRG1TM mice and ten wild-type mice were injected i.p. with either clozapine (1 mg/kg) or vehicle 25 min prior to testing. Clozapine at the dose chosen reversed the increased activity of NGR1TM mice while it had no effect on the activity of litter-mate control mice (FIG. 8). The hyperactivity in the NRG1TM mice was, therefore, ameliorated with clozapine, which is in keeping with what has been observed in models for schizophrenia (Mohn, et al., *Cell* 98, 427 (1999), Glickstein, et al., *Pharmacol. Ther.* 91, 63 (2001)).

We performed MK-801 (NMDA antagonist) binding studies of forebrain homogenates from NRG1 hypomorphs created by Gerlai et al. (R. Gerlai, P. Pisacane, S. Erickson, *Behav. Brain Res.* 109, 219 (2000)) and control mice. The pKD values were analysed by ANOVA and did not reveal any differences between the wild type and the mutant mice. Bmax values (pmoles/mg protein) were found to be significantly different (P=0.0068 (one sided)) in the mutant than in the wild type mice suggesting that there are 16% fewer functional NMDA receptors in the mutant animals overall (Table 5).

It is also of interest here that there appears to be reduction in the numbers of functional NMDA receptors in certain regions of brains from schizophrenics. This is in keeping with reports suggesting a role for NRG1 in regulation of NMDA subunit expression (G. D. Fischbach, K. M. Rosen, *Annu. Rev. Neurosci.* 20, 429 (1997)).

TABLE 5

[$^3$H] MK801 binding. Concentrations of [$^3$H] MK801 in homogenate from forebrains of NRG1 knockout and wild type (WT) mice. Data are given in (pmoles/mg protein), mean ± SD (one sided P value is given).

| Mouse | Count | $B_{max}$ values (pmoles/mg protein) | | P value |
| --- | --- | --- | --- | --- |
| | | Average | SD | |
| NRG1 | 16 | $1.23 \times 10^{-12}$ | $2.22 \times 10^{-13}$ | $6.8 \times 10^{-3}$ |
| WT | 18 | $1.43 \times 10^{-12}$ | $2.14 \times 10^{-13}$ | |

Example 3

ErbB4 as a Target

Neuregulin (NRG) signals through a receptor tyrosine kinase family known as the ErbB receptors. The four different receptors (ErbB1-4) that belong to this family all have high protein sequence homology. The NRG1 gene binds to either ErbB3 or ErbB4 leading to homo-(ErbB3/3, ErbB4/4) or heterodimer (ErbB2/3, ErbB2/4) formation. Since ErbB3 has a defective kinase domain, only the ErbB2/3 heterodimer mediates signalling. Dimerization of ErbB4 caused by ligand binding leads to tyrosine phosphorylation of the receptor by its partner on four sites. Of these three sites, Y1056, Y1188 and Y1242 have been identified as docking sites for the SH2 domain containing proteins Shc (Y1188 and Y1242) and PI3 kinase (Y1056). Recruitment of these proteins leads to propagation of the NRG1 signal trough their respective signalling pathways followed by biological response.

NRG acts as a trophic factor for neurons and glia and regulates the expression of genes important for neuronal biology such as nerurotransmitter receptors and voltage-gated ion channels. Both NRG1 and the ErbB receptors are widely expressed during development and in the adult. ErbB3 and ErbB4 are the major ErbB receptors in brain although low levels of ErbB2 expression is found in glia. Of these the ErbB4 is the receptor that is most restricted to neurons. It is most abundant in the cerebral cortex, slightly lower in the midbrain, and lowest in the cerebellum and brainstem. There is a good spatial correlation between expression of NRG1 and ErbB4 in the central nervous system and more importantly, the pattern of ErbB4 expression correlates well with the neuronal circuitry that has been implicated in schizophrenia. For example, in the cortex, ErbB4 is expressed by GABAergic interneurons, a subset of these appear to be primarily affected in schizophrenia.

It appears that schizophrenia is caused by a defect in NRG1/ErbB4 signalling that leads to decrease in the GABAergic interneurons; therefore, to treat schizophrenia (e.g., to correct the defect), an agent that potentiates the ErbB4 kinase activity can be used.

High Throughput Screening (HTS) for Agents that Activate ErbB4

The ErbB4 gene encodes for a transmembrane protein of 1308 amino acids (see, e.g., GenBank Accession number L07868, the entire teachings of which are incorporated herein by reference). The extracellular domain contains the ligand binding site. The protein has a single transmembrane domain that anchors it to the plasma membrane. The intracellular domain (amino acids 676-1308) contains the tyrosine kinase (amino acids 713-988) and the three tyrosine phosphorylation sites necessary for signalling (Y1056, Y1188 and Y1242). Assay standard deviation is 10%. An active compound considered for screening is below 70%.

In Vitro Based Protein Assay

The following general strategy is employed: recombinant proteins containing the ErbB4 kinase domain are expressed; HTS assay based on the kinase activity is developed; and compound libraries are screened for agents that potentiate ErbB4 activity.

Constructs

Several constructs were made encompassing the intracellular domain of ErbB4, these are: #1 amino acids 713-988, #2 amino acids 676-1308, #3 amino acids 676-1030, #4 amino acids 676-1119, #5 amino acids 676-1213 and #6 amino acids 676-1308 that contains mutation at position 863 (Aspartic acid to Aspargine) creating kinase-defective mutant of ErbB4. Numbering is relative to GenBank Accession number L07868. Clones were made by PCR amplification from plasmids containing the full length ErbB4 receptor. All clones contain the small antibody epitope AU1 on the N-terminus for detection of the protein and six Histidines at either end for purification. PCR products were cloned into the entry vector from the Gateway cloning system (Life Technology) and sequenced. Following validation of the sequence, the inserts were transferred into the pFastBac vector using the Gateway system for generation of Baculovirus.

Methodology

All constructs were made by PCR, using full length human ErbB4 (gift of Kermit Carraway) as template. Each of the 5' primers contained the required sequence for homologous recombination in the Gateway system (underlined), Kozak sequence (undercase), ATG, the six codons of the AU1 epitope (bold) and 18 bases started from the indicated amino acid (example of primer: 5' GGGG ACA AGT TTG TAC AAA AAA GCA GGC Tcc acc ATG GAC ACC TAT CGC TAT ATA XXX XXX XXX XXX XXX XXX 3', X represents the gene specific part of the primer; SEQ ID NO: 1675). The 3' primer included 18 gene specific bases upstream of the indicated amino acid for the construct and the sequence for the homologous recombination (5' GGG GAC CAC TTT GTA CAA GAA AGC TGG GT 3'; SEQ ID NO: 1676) in addition to codons for six histidines. One hundred microliter reaction was performed using Pfu turbo polymerase (Stratagene, according to manufacturer recommendation). PCR fragments were cloned into the Entry Vector, using the BP reaction according to the manufacturer protocol (Invitrogen). The plasmid was then transfected into DH5a cells and vector DNA isolated from bacteria colonies, followed by sequencing to verify the construct. Once an error free construct was obtained the insert was transferred into the pFastBac (pD-EST-10) vector (Invitrogene, see manufactures protocol). Plasmid was transformed into DH10Bac cells containing a baculovirus shuttle vector. Following site-specific transposition, high-molecular weight DNA was isolated and transfected into Sf9 cells using Bacfectin (Gibco/BRL, see manufactures protocol) and BacPac-Grace media (Clontech). Following three days incubation media was harvested, containing virus. The virus was then used for second round of infection, following three days incubation before harvesting. Two more rounds were done before high titre virus was obtained. For big scale purification of recombinant protein 200 ul-1 ml of the high titre virus was use to infect 500 mls of Sf9 cells at the density of $1*10^6$ cells/ml.

Expression and Purification of Recombinant Protein

Recombinant protein was expressed in Sf9 cells. Insect cells were infected with high titer virus stock. Following 72 hour infection, the recombinant protein was purified (see method). The quality of the purified protein and estimation of protein concentration was done by gel electrophoresis followed by silver staining of the gel (known amount of BSA was used as a standard), western blotting and Bradford assay.

Cells were harvested and washed 2× in icecold PBS pH 7. The cell pellet was resuspended in lysis buffer (20 mm Tris pH 8, 150 mM NaCl (molecular biology grade, CALBIOCHEM), 5 mM b-mercaptaethanol, 2 mm MgCl, 25% glycerol (ultra pure, USB), 2% N-Octyl-b-d-Glycopyrannoside (Molecular biology grade, CALBIOCHEM) and protease inhibitors set III (CALBIOCHEM)) using approximately 10 ml/1 g cells, and incubated for 1 hour on ice.

Lysate was centrifuged for 10 minutes at 200 g followed by centrifugation at 3500 g for 30 minutes. NaCl and Immidiazole (ultragrade, CALBIOCHEM) pH8 were added to the supernatant to a final concentration of 300 mM and 5 mM respectively.

Ni-NTA (Qiagen) was washed with 10 mM Tris pH8, and added to the lysate (approximately 1 ml/200 ml lysate). Binding was performed for 2 hours at 4 C with low speed stirring (magnetic stirring, 100 rpm). Subsequently the Ni-NTA was palleted by certification and transferred to an FPLC column. The column was washed with lysis buffer containing 300 mM NaCl and 5 mM Immidiazole, pH 8 followed by 2 washing steps using 20 mM Tris pH 8, 300 mM NaCl, 20% glycerol 2 mM b-mercaptaethanol, 1% NOG, 25 mM Immidiazole, and 20 mM Tris pH 8, 1 M NaCl, 10% glycerol, 2 mM b-mercaptoethanol, 0.2% NOG, Immidiazole 40 mM respectively. 10× the volume of the column was used for each wash step. After 30 minutes incubation in elution buffer, His tagged protein was eluted in 40 mM Tris pH 8, 150 mM NaCl, 25% glycerol, 4 mM b-mercaptaethanol, 2 mM MgCl, 0.1% NOG, 150 mM Immidiazole using 15× column volume.

The enzyme was divided up and stored at −80 C.

Evaluation of Kinase Activity

Fluoresence polarization (FP) was used to assay for kinase activity. FP is based on change in the polarization of polarized light that is shined through solution containing phosphopeptide (tracer) that is covalently linked to a fluorophore and phosphoantibody. If another source of phosphorylated molecule is in the solution (such as phosphorylated substrate), there will be displacement of the antibody from the tracer over to the substrate and the FP value will change, indicating that the kinase that phosphorylated the substrate has activity.

Construct 676-1308 has been extensively analysed using this assay. The construct contains the full intracellular domain, harbouring both the kinase domain and the C-terminus that includes the autophosphoylation sites. Therefore when this construct is used no additional substrate is added and the activity of the kinase domain is evaluated based on the autophosphorylation of the C-terminal tyrosines.

TKXtraTM-Tyrosine Kinase Exploration Kit from LjL BioSystems was use for evaluation of the kinase activity. According to the method, purified enzyme is diluted in 20 mM Hepes, 0.05% NOG, 2 mM b-mercaptaethanol, 100 ug/ml BSA, 15 mm MgCl, 4 mM. The kinase reaction is started by addition of ATP, to a final concentration of 250 uM (20 ul reaction volume). After 1 hour incubation the reaction is stopped by addition of 1 ul of 20 mM EDTA. The Fluorescence polarization assay is performed as described in the protocol provided by the manufactures. Briefly, antibody diluted in assay buffer is added followed by addition of tracer diluted in assay buffer. The end volume of the reaction is 40 ul. After 30 minutes incubation at room temperature in the dark the fluorescence polarization is measured using a LJL Analyst.

Repeated assays using different batches of enzyme has established the IC50 value for this construct at 0.5-4 nM. Western blotting was performed using antibody that recognizes phosphorylated tyrosine to confirm the FP assay and to establish that the change in the FP value is due to autophosphorylation on tyrosines in the C-terminus of the protein. Since there are several phosphorylation sites in the C-terminus, it is important to know how many of them and which ones are used. To evaluate this, kinase assay was performed and the phosphorylation status evaluated by trypsin digest and mass spectrometry analysis (MALDI-TOF). The results indicated that two tyrosines (1242 a major side and 1284 minor side) are phosphorylated in the C-terminus.

HTS Assay

The low throughput assay was then scaled up to HTS level, by adapting the assay to 384 well format, integrating high throughput robots for pipeting, and establishing database and other software tools to evaluate the data.

Screening has now been started using the 676-1308 protein. The first compounds of the one hundred thousand that will be screened have been tested using enzyme final concentration at 1 mM.

Purified enzyme is diluted in 20 mM Hepes, 0.05% NOG, 2 mM b-mercaptaethanol, 100 ug/ml BSA, 15 mm MgCl, 4 mM MnCl and incubated for 30 minutes at room temperature with 10 or 30 uM compound. Compounds are dissolved in 100% DMSO. The kinase reaction is started by addition of ATP, to a final concentration of 250 uM. The reaction volume is 20 ul, and the DMSO concentration in the assay at 10%. After 1 hour incubation the reaction is stopped by addition of 20 mM EDTA. The fluorescence polarization assay is performed as before.

The standard deviation (SD) in the assay is around 10%. Compounds considered to be active will fall 3SD away from the mean signal for the enzyme concentration that is used. Every compound that falls into that category will be further tested, see below.

Specificity of the Identified Hits

Once a compound has been identified as a potential activator of the ErbB4 kinase, its specificity towards ErbB4 will be tested using the same in vitro kinase assay and recombinant ErbB4 protein (made by us as described for ErbB4), ErbB1 and the insulin receptor (Biomol) as targets. In addition, the ability of the compounds to activate ErbB4 and other kinases in vivo will be tested. Plasmid expressing the ErbB4, ErbB2 and the insulin receptor will be transfecting into NIH3T3 cells, followed by selection of cells that harbor the DNA by selecting for neomycin resistant. Individual clones will be grown out and evaluated for expression of the receptors by western bloting. Cell lines expressing the receptors will then be treated with the compound and evaluated for activity by protein kinase assays or by western blotting using antibodies that recognize the phosphorylated form of ErbB4 or its downstream signalling components (i.e., MAP kinase, New England Biolabs).

Compounds that meet these characteristics will then be further developed, with the goal of finding highly active compounds that specifically activate ErbB4, cross the blood brain barrier, are non-toxic, and have the appropriate half-life. These candidate compounds will then be tested on available schizophrenia animal models.

Discussion

Evidence to Support Role of NRG1 as Candidate Gene for Association with the Pathogenesis of Schizophrenia.

Through the work described above we have identified the NRG1 gene as a strong candidate for a gene playing a role in the pathogenesis of schizophrenia. We present three lines of evidence in support of this role for NRG1.

The first is genetic evidence consisting of suggestive linkage of schizophrenia to chromosome 8p in Icelandic families. This is supported by coincidence with suggestive linkage in four other populations (A. E. Pulver et al., *Am. J. Med. Genet.* 60, 252 (1995); H. W. Moise, et al., *Nature. Genet.* 11, 321 (995); K. S. Kendler et al., *Am. J. Psychiatry* 153, 1534 (1996); D. F. Levinson et al., *Am. J. Med. Genet.* 67, 580 (1996); R. E. Straub, C. J. MacLean, D. Walsh, K. S. Kendler, *Cold Spring Harb. Symp. Quant. Biol.* 61, 823 (1996); J. L Blouin et al., *Nature Genet.* 20, 70 (1998); S. H. Shaw et al., *Am. J. Med. Genet.* 81, 364 (1998); C. A. Kaufmann et al., *Am. J. Med. Genet.* 81, 282 (1998); I. Hovatta et al., *Mol. Psychiatry.* 3, 452 (1998); L. M. Brzustowicz et al., *Am. J. Hum. Genet.* 65, 1096 (1999); and H. M. Gurling et al., *Am. J. Hum. Genet.* 68, 661 (2001)). This is further supported by highly significant association of overlapping haplotypes, that contain only one gene within the overlap, namely NRG1. The population attributed risk for the identified core haplotype is 16%, which is a substantial contribution to the public health burden. The weakness in the genetic evidence is that we have not yet found a clear pathogenic mutation, which may, however, be a par for the course in the genetics of common diseases.

The second line of evidence is that mice hypomorphic for each of two mutations in NRG1 and one mutation in a receptor for NRG1 display behavior that overlaps with mouse models for schizophrenia and this is reversed with clozapine in a NRG1 mutant line.

The third line of evidence is that the number of NMDA receptors in the NRG1 hypomorphs is reduced which is in keeping with observations made on brains from schizophrenia patients. Thus these results argue that variants of the NRG1 gene contribute to the pathogenesis of schizophrenia in some patients, probably through a decrease in NRG1 signaling. The overlap in behavioral phenotype between the NRG1 and ErbB4 hypomorphic mice, and the lack of a similar behavioral phenotype in ErbB2 or ErbB3 mice (R. Gerlai, P. Pisacane, S. Erickson, *Behav. Brain Res.* 109, 219 (2000)), argues that the defect is primarily neuronal. Although each line of evidence is not conclusive, when put together they constitute a strong case for NRG1 as a culprit in the pathogenesis of schizophrenia. Furthermore we have discovered in the NRG1 hypomorphs an excellent animal model for schizophrenia that is based on understanding of the genetics of the disease.

Our behavioral data on the NRG1 and ErbB4 mouse mutants provide additional evidence for a role of NRG1 in schizophrenia. We replicate the work done by Gerlai et al. (R. Gerlai, P. Pisacane, S. Erickson, *Behav. Brain Res.* 109, 219 (2000)) on a different NRG1 mutant and we show that both the NRG1TM and the ErbB4 hypomorph mice are hyperactive, a phenotype that overlaps with behaviors induced by PCP in normal mice. Clozapine reduced the hyperactivity in the NRG1 mice as it does in PCP treated mice and mice with reduced number of NR2A receptor subunits (A. R. Mohn, R. R. Gainetdinov, M. G. Caron, B. H. Koller, *Cell* 98, 427 (1999)). The clozapine reversal, therefore, further supports that the hyperactivity observed in the NRG1 mice is related to schizophrenic phenotypes.

TABLE 1

| LOCUS | NRG1 | 1503841 bp | DNA |
|---|---|---|---|
| DEFINITION | Human neuregulin 1 gene (NRG1), complete cds, complete sequence. | | |
| ACCESSION | | | |
| VERSION | | | |
| KEYWORDS | . | | |
| SOURCE | human. | | |
| ORGANISM | *Homo sapiens* | | |
| | Eukaryota; Metazoa; Chordata; Craniata; Vertebrata; | | |

TABLE 1-continued

```
              Euteleostomi;
              Mammalia; Eutheria; Primates; Catarrhini; Hominidae; Homo.
REFERENCE     1  (bases 1 to 1503841)
  AUTHORS     _____
  TITLE       Direct Submission
  JOURNAL     Submitted (13-FEB-2001) deCODE genetics, Inc., Lynghals 1,
              Reykjavik 110, Iceland
COMMENT       This sequence has been assembled partly from BAC sequences
              available from GenBank (AC012139.3, AC068672.2,
              AC083759.2,
              AC004040.1, AC027024.3, AC022833.2, AC021909.5,
              AC022850.3,
              AC023948.2, AC068359.2, AC083977.2, AF181895.2,
              AF128834.2,
              AF182108.2), and partly from BAC sequences generated in-
house
              (RP11-29H12, RP11-450K14, RP11-478B14, RP11-420M9, RRP11-
              22F19,
              RP11-72H22, RP11-244L21, RP11-225C17, RP11-317J8).
FEATURES            Location/Qualifiers
     source         1..1503841
                    /organism="Homo sapiens"
                    /db_xref="taxon : 9606"
                    /chromosome="8"
                    /map="8p12"
                    /clones="BACs RP11-10L15, RP11-566H8, CTD-386L14,
                    187F3
                    (LBNL H111), RP11-583F20, RP11-147C21, RRP11-22F19,
                    RP11-275E10, RP11-669B22, RP11-468C1, RP11-317J8,
                    CTD-2329M5, GS1-57G24, RP11-11N9, RP11-29H12,
                    RP11-450K14,
                    RP11-478B14, RP11-420M9, RP11-72H22, RP11-244L21,
                    RP11-225C17."
                    /note="There are 2 gaps of unknown size in this
                    sequence,
                    as follows: 39177..39276, 1421616..1421715."
     gene           244312..1369465
                    /gene="NRG1"
                    /note="neuregulin 1"
     exon           244205..244348
                    /gene="NRG1"
                    /number=1
     CDS
join(244312..244348,1200888..1201065,1210623..1210744,
1332978..1333107,1347707..1347765,1359432..>1359481)
                    /gene="NRG1"
                    /codon_start=1
                    /product="pACF-6_30" (clone ACF-6_30)
/translation="MGKGRAGRVGTTALPPRLKEMKSQESAAGSKLVLRCETSSEYSS

LRFKWFKNGNELNRKNKPQNIKIQKKPGKSELRINKASLADSGEYMCKVISKLGNDSA

SANITIVESNATSTSTTGTSHLVKCAEKEKTFCVNGGECFMVKDLSNPSRYLCKCPNE
                    FTGDRCQNYVMASFYKAEELYQKRVLTITGIC"
     exon           244641..245646
                    /gene="NRG1"
                    /number=2
     CDS
join(244902..245646,1200888..1201065,1210623..1210744,
                    1332978..1333107,1347707..1347800)
                    /gene="NRG1"
                    /codon_start=1
                    /product="neuregulin; glial growth factor 2"
                    /protein_id="AAB59622.1"
                    /db_xref="GI:292048"
/translation="MRWRRAPRRSGRPGPRAQRPGSAARSSPPLPLLPLLLLLGTAAL

APGAAAGNEAAPAGASVCYSSPPSVGSVQELAQRAAVVIEGKVHPQRRQQGALDRKAA

AAAGEAGAWGGDREPPAAGPRALGPPAEEPLLAANGTVPSWPTAPVPSAGEPGEEAPY

LVKVHQVWAVKAGGLKKDSLLTVRLGTWGHPAFPSCGRLKEDSRYIFFMEPDANSTSR

APAAFRASFPPLETGRNLKKEVSRVLCKRCALPPRLKEMKSQESAAGSKLVLRCETSS

EYSSLRFKWFKNGNELNRKNKPQNIKIQKKPGKSELRINKASLADSGEYMCKVISKLG

NDSASANITIVESNATSTSTTGTSHLVKCAEKEKTFCVNGGECFMVKDLSNPSRYLCK
                    CPNEFTGDRCQNYVMASFYSTSTPFLSLPE"
```

TABLE 1-continued

```
                     /note="This sequence of neuregulin/glial growth
                     factor 2
                     differs from the one in Genbank (GI:292048) at
                     residue 253
                     (R instead of Q)."
     CDS
join(<245598..245646,1200888..1201065,1210623..1210744,
1332978..1333107,1347707..1347765,1354621..1354644,
                     1359432..>1359481)
                     /gene="NRG1"
                     /codon_start=1
                     /product="pOG-140-80" (clone OG-140-80)
/translation="GRNLKKEVSRVLCKRCALPPRLKEMKSQESAAGSKLVLRCETSS

EYSSLRFKWFKNGNELNRKNKPQNIKIQKKPGKSELRINKASLADSGEYMCKVISKLG

NDSASANITIVESNATSTSTTGTSHLVKCAEKEKTFCVNGGECFMVKDLSNPSRYLCK
                     CPNEFTGDRCQNYVMASFYKHLGIEFMEAEELYQKRVLTITGIC"
     CDS
join(<245598..245646,1200888..1201065,1210623..1210744,
                     1219543..1219593,1332978..>1333066)
                     /gene="NRG1"
                     /codon_start=1
                     /product="pSB-9_26" (clone SB-9_26)
/translation="GRNLKKEVSRVLCKRCALPPRLKEMKSQESAAGSKLVLRCETSS

EYSSLRFKWFKNGNELNRKNKPQNIKIQKKPGKSELRINKASLADSGEYMCKVISKLG

NDSASANITIVESNEIITGMPASTEGAYVSSATSTSTTGTSHLVKCAEKEKTFCVNGG
                     ECF"
     gene            629728..744437
                     /gene="Neuregulin 1 Associated Gene 1"
     exon            629728..629804
                     /gene="Neuregulin 1 Associated Gene 1"
                     /number=1
     exon            630975..631187
                     /gene="Neuregulin 1 Associated Gene 1"
                     /number=2
     CDS             join(<630975..631187,634335..>634376)
                     /gene="Neuregulin 1 Associated Gene 1"
                     /codon_start=1
                     /product="pACF-14F-64" (clone ACF-14F-64)
/translation="FYQLGLHLLSLEHIQSFFLFFFLRRSLALSPRLECSGRISTHCK
                     LRLPDSRHSPASDPGVAGTTGACAISMNRAAIRTKTVLRSS"
     exon            631283..631320
                     /gene="Neuregulin 1 Associated Gene 1"
                     /number=3
     exon            634335..634441
                     /gene="Neuregulin 1 Associated Gene 1"
                     /number=4A
     exon            634335..634892
                     /gene="Neuregulin 1 Associated Gene 1"
                     /number=4B
     CDS
join(634386..634441,635332..635415,744176..744179)
                     /gene="Neuregulin 1 Associated Gene 1"
                     /codon_start=1
                     /product="pIMAGE:727960" (clone ="IMAGE:727960";
3' end
                     sequence in Genbank, Accession AA435550, 5' end
sequence
                     in Genbank, Accession AA394309)
/translation="MWCEMFYGQKMEMRCRNWRLRINLKTKSRFWPDTDAKVTPMLSL
                     LLR"
     CDS             (634386..634445)
                     /gene="Neuregulin 1 Associated Gene 1"
                     /codon_start=1
                     /product="pACF-E77B" (clone ACF-E77B)
                     /translation="MWCEMFYGQKMEMRCRNWR"
     CDS             join(<634404..634441,635332..635491)
                     /gene="Neuregulin 1 Associated Gene 1"
                     /codon_start=1
                     /product="pIMAGE:1643938" (clone
="IMAGE:
1643938";
3' end
                     sequence in Genbank, Accession AI027638)
/translation="YGQKMEMRCRNWRLRINLKTKSRFWPDTDAKVTPMLSLLLRYKL
                     PYFKQLFHLFNSIPFLSLFHM"
```

TABLE 1-continued

```
    exon            635332..635415
                    /gene="Neuregulin 1 Associated Gene 1"
                    /number=5A
    exon            635332..635509
                    /gene="Neuregulin 1 Associated Gene 1"
                    /number=5B
    exon            744176..744437
                    /gene="Neuregulin 1 Associated Gene 1"
                    /number=6
    exon            826010..826101
                    /gene="NRG1"
                    /number=3
    CDS
join(826053..826101,1200888..1201065,1210623..1210744,
                    1332978..>1333051)
                    /gene="NRG1"
                    /codon_start=1
                    /product="pSB-9A-a_04" (clone SB-9A-a_04)
/translation="MKKRNEMIFLATLKNKALPPRLKEMKSQESAAGSKLVLRCETSS EYSSLRFKWFKNGELNRKNKPQNIKIQKKPGKSELRINKASLADSGEYMCKVISKLG
                    NDSASANITIVESNATSTSTTGTSHLVKCAEKEKTFCVN"
    CDS
join(826053..826101,1200888..1201065,1210623..1210744,
1219543..1219593,1221864..1221914,1332978..>1333105)
                    /gene="NRG1"
                    /codon_start=1
                    /product="pOG-6_17" (clone OG-6_17)
/translation="MKKRNEMIFLATLKNKALPPRLKEMKSQESAAGSKLVLRCETSS

EYSSLRFKWFKNGELNRKNKPQNIKIQKKPGKSELRINKASLADSGEYMCKVISKLG

NDSASANITIVESNEIITGMPASTEGAYVSSESPIRISVSTEGANTSSSTSTSTTGTS
                    HLVKCAEKEKTFCVNGGECFMVKDLSNPSRYLC"
    CDS
join(826053..826101,1200888..1201065,1210623..1210744,
                    1219543..1219593,1332978..>1333015)
                    /gene="NRG1"
                    /codon_start=1
                    /product="pSB-20_90" (clone SB-20_90)
/translation="MKKRNEMIFLATLKNKALPPRLKEMKSQESAAGSKLVLRCETSS EYSSLRFKWFKNGELNRKNKPQNIKIQKKPGKSELRINKASLADSGEYMCKVISKLG
                    NDSASANITIVESNEIITGMPASTEGAYVSSATSTSTTGTSHLV"
    exon            826308..826355
                    /gene="NRG1"
                    /number=4
    exon            1034243..1034321
                    /gene="NRG1"
                    /number=5
    exon            1153295..1153886
                    /gene="NRG1"
                    /number=6
    CDS
join(1153787..1153886,1200888..1201065,1210623..1210744,
1219543..1219593,1221864..1221914,1332978..1333107,
1347707..1347765,1354621..1354644,1359432..1359534,
1361463..1361589,1364363..1364493,1365257..1365463,
                    1368811..1369465)
                    /gene="NRG1"
                    /codon_start=1
                    /product="Heregulin-beta1"
                    /protein_id="AAA58639.1"
                    /db_xref="GI:183995"
/translation="MSERKEGRGKGKGKKKERGSGKKPESAAGSQSPALPPRLKEMKS

QESAAGSKLVLRCETSSEYSSLRFKWFKNGELNRKNKPQNIKIQKKPGKSELRINKA

SLADSGEYMCKVISKLGNDSASANITIVESNEIITGMPASTEGAYVSSESPIRISVST

EGANTSSSTSTSTTGTSHLVKCAEKEKTFCVNGGECFMVKDLSNPSRYLCKCPNEFTG

DRCQNYVMASFYKHLGIEFMEAEELYQKRVLTITGICIALLVVGIMCVVAYCKTKKQR

KKLHDRLRQSLRSERNNTMNIANGPHHPNPPPENVQLVNQYVSKNVISSEHIVEREAE

TSFSTSHYTSTAHHSTTVTQTPSHSWSNGHTESILSESHSVIVMSSVENSRHSSPTGG

PRGRLNGTGGPRECNSFLRHARETPDSYRDSPHSERYVSAMTTPARMSPVDFHTPSSP
```

TABLE 1-continued

```
KSPPSEMSPPVSSMTVSMPSMAVSPFMEEERPLLLVTPPRLREKKFDHHPQQFSSFHH

NPAHDSNSLPASPLRIVEDEEYETTQEYEPAQEPVKKLANSRRAKRTKPNGHIANRLE

VDSNTSSQSSNSESETEDERVGEDTPFLGIQNPLAASLEATPAFRLADSRTNPAGRFS
                    TQEEIQARLSSVIANQDPIAV"
                    /note="This sequence of heregulin-beta1 differs
                    from the
                    one in Genbank (GI:183995) at residues 38 (R
                    instead of Q)
                    and 294 (T instead of M)."
     CDS
join(1153787..1153886,1200888..1201065,1210623..1210744,
1219543..1219593,1221864..1221914,1332978..1333107,
1347707..1347765,1359432..1359534,1361463..1361589,
1364363..1364493,1365257..1365463,1368811..1369465)
                    /gene="NRG1"
                    /codon_start=1
                    /product="Heregulin-beta2"
                    /protein_id="AAA58640.1"
                    /db_xref="GI:183997"
/translation="MSERKEGRGKGKGKKKERGSGKKPESAAGSQSPALPPRLKEMKS

QESAAGSKLVLRCETSSEYSSLRFKWFKNGNELNRKNKPQNIKIQKKPGKSELRINKA

SLADSGEYMCKVISKLGNDSASANITIVESNEIITGMPASTEGAYVSSESPIRISVST

EGANTSSSTSTSTTGTSHLVKCAEKEKTFCVNGGECFMVKDLSNPSRYLCKCPNEFTG

DRCQNYVMASFYKAEELYQKRVLTITGICIALLVVGIMCVVAYCKTKKQRKKLHDRLR

QSLRSERNNTMNIANGPHHPNPPPENVQLVNQYVSKNVISSEHIVEREAETSFSTSHY

TSTAHHSTTVTQTPSHSWSNGHTESILSESHSVIVMSSVENSRHSSPTGGPRGRLNGT

GGPRECNSFLRHARETPDSYRDSPHSERYVSAMTTPARMSPVDFHTPSSPKSPPSEMS

PPVSSMTVSMPSMAVSPFMEEERPLLLVTPPRLREKKFDHHPQQFSSFHHNPAHDSNS

LPASPLRIVEDEEYETTQEYEPAQEPVKKLANSRRAKRTKPNGHIANRLEVDSNTSSQ

SSNSESETEDERVGEDTPFLGIQNPLAASLEATPAFRLADSRTNPAGRFSTQEEIQAR
                    LSSVIANQDPIAV"
                    /note="This sequence of heregulin-beta2 differs
                    from the
                    one in Genbank (GI:183997) at residues 38 (R
                    instead of Q)
                    286 (T instead of M) and 460 (M instead of K)."
     CDS
join(1153787..1153886,1200888..1201065,1210623..1210744,
1219543..1219593,1221864..1221914,1332978..1333111)
                    /gene="NRG1"
                    /codon_start=1
                    /db_xref="MIM:142445"
                    /db_xref="LocusID:3084"
                    /product="heregulin, alpha (45kD, ERBB2 p185-
                    activator)"
                    /protein_id="NP_004486.1"
                    /db_xref="GI:4758526"
/translation="MSERKEGRGKGKGKKKERGSGKKPESAAGSQSPALPPRLKEMKS

QESAAGSKLVLRCETSSEYSSLRFKWFKNGNELNRKNKPQNIKIQKKPGKSELRINKA

SLADSGEYMCKVISKLGNDSASANITIVESNEIITGMPASTEGAYVSSESPIRISVST

EGANTSSSTSTSTTGTSHLVKCAEKEKTFCVNGGECFMVKDLSNPSRYLCK"
                    /note="This sequence of heregulin, alpha (45kD,
                    ERB2 p185-
                    activator) differs from the one in Genbank
                    (GI:4758526) at
                    residue 38 (R instead of Q)."
     CDS
join(1153787..1153886,1200888..1201065,1210623..1210744,
1219543..1219593,1221864..1221914,1332978..1333107,
1347040..1347107,1359432..1359534,1361463..1361589,
1364363..1364493,1365257..1365463,1368811..1369465)
                    /gene="NRG1"
                    /codon_start=1
```

TABLE 1-continued

```
                /product="Heregulin-alpha"
                /protein_id="AAA58638.1"
                /db_xref="GI:183993"
/translation="MSERKEGRGKGKGKKKERGSGKKPESAAGSQSPALPPRLKEMKS

QESAAGSKLVLRCETSSEYSSLRFKWFKNGNELNRKNKPQNIKIQKKPGKSELRINKA

SLADSGEYMCKVISKLGNDSASANITIVESNEIITGMPASTEGAYVSSESPIRISVST

EGANTSSSTSTSTTGTSHLVKCAEKEKTFCVNGGECFMVKDLSNPSRYLCKCQPGFTG

ARCTENVPMKVQNQEKAEELYQKRVLTITGICIALLVVGIMCVVAYCKTKKQRKKLHD

RLRQSLRSERNNTMNIANGPHHPNPPPENVQLVNQYVSKNVISSEHIVEREAETSFST

SHYTSTAHHSTTVTQTPSHSWSNGHTESILSESHSVIVMSSVENSRHSSPTGGPRGRL

NGTGGPRECNSFLRHARETPDSYRDSPHSERYVSAMTTPARMSPVDFHTPSSPKSPPS

EMSPPVSSMTVSMPSMAVSPFMEEERPLLLVTPPRLREKKFDHHPQQFSSFHHNPAHD

SNSLPASPLRIVEDEEYETTQEYEPAQEPVKKLANSRRAKRTKPNGHIANRLEVDSNT

SSQSSNSESETEDERVGEDTPFLGIQNPLAASLEATPAFRLADSRTNPAGRFSTQEEI
                QARLSSVIANQDPIAV"
                /note="This sequence of heregulin-alpha differs
                from the
                Genbank one (GI:183993) at residue 289 (T instead
                of M)."
        CDS
join(1153787..1153886,1200888..1201065,1210623..1210744,
1219543..1219593,1221864..1221914,1332978..1333107,
1347040..1347107,1359432..1359534,1361463..1361589,
1364363..1364493,1365257..1365463,1368281..1368401)
                /gene="NRG1"
                /codon_start=1
                /product="Neu differentiation factor"
                /protein_id="AAA19951.1"
                /db_xref="GI:408403"
/translation="MSERKEGRGKGKGKKKERGSGKKPESAAGSQSPALPPRLKEMKS

QESAAGSKLVLRCETSSEYSSLRFKWFKNGNELNRKNKPQNIKIQKKPGKSELRINKA

SLADSGEYMCKVISKLGNDSASANITIVESNEIITGMPASTEGAYVSSESPIRISVST

EGANTSSSTSTSTTGTSHLVKCAEKEKTFCVNGGECFMVKDLSNPSRYLCKCQPGFTG

ARCTENVPMKVQNQEKAEELYQKRVLTITGICIALLVVGIMCVVAYCKTKKQRKKLHD

RLRQSLRSERNNTMNIANGPHHPNPPPENVQLVNQYVSKNVISSEHIVEREAETSFST

SHYTSTAHHSTTVTQTPSHSWSNGHTESILSESHSVIVMSSVENSRHSSPTGGPRGRL

NGTGGPRECNSFLRHARETPDSYRDSPHSERHNLIAELRRNKAHRSKCMQIQLSATHL
                RSSSIPHLGFIL"
                /note="This sequence of neu differentiation
                factor differs
                from the Genbank one (GI:408403) at residue 289
            (T instead
            of M)."
        CDS
join(1153787..1153886,1200888..1201065,1210623..1210744,
1219543..1219593,1221864..1221914,1332978..1333107,
                1347707..1347800)
                /gene="NRG1"
                /codon_start=1
                /product="Heregulin-beta3"
                /protein_id="AAA58641.1"
                /db_xref="GI:183999"
/translation="MSERKEGRGKGKGKKKERGSGKKPESAAGSQSPALPPRLKEMKS

QESAAGSKLVLRCETSSEYSSLRFKWFKNGNELNRKNKPQNIKIQKKPGKSELRINKA

SLADSGEYMCKVISKLGNDSASANITIVESNEIITGMPASTEGAYVSSESPIRISVST

EGANTSSSTSTSTTGTSHLVKCAEKEKTFCVNGGECFMVKDLSNPSRYLCKCPNEFTG
                DRCQNYVMASFYSTSTPFLSLPE"
                /note="This sequence of heregulin-beta3 differs
                from the
```

TABLE 1-continued

```
                 Genbank one (GI:183999) at residue 38 (R instead
                 of Q)."
     CDS
join(<1153808..1153886,1200888..1201065,1210623..1210744,
                 1332978..>1333066)
                 /gene="NRG1"
                 /codon_start=1
                 /product="pSB-20_62" (clone SB-20_62)
/translation="RGKGKGKKKERGSGKKPESAAGSQSPALPPRLKEMKSQESAAGS

KLVLRCETSSEYSSLRFKWFKNGNELNRKNKPQNIKIQKKPGKSELRINKASLADSGE

YMCKVISKLGNDSASANITIVESNATSTSTTGTSHLVKCAEKEKTFCVNGGECF"
     CDS
join(<1153814..1153886,1200888..1201065,1210623..1210744,
                 1219543..1219593,1332978..>1333066)
                 /gene="NRG1"
                 /codon_start=1
                 /product="pSB-11_05" (clone SB-11_05)
/translation="KGKGKKKERGSGKKPESAAGSQSPALPPRLKEMKSQESAAGSKL

VLRCETSSEYSSLRFKWFKNGNELNRKNKPQNIKIQKKPGKSELRINKASLADSGEYM

CKVISKLGNDSASANITIVESNEIITGMPASTEGAYVSSATSTSTTGTSHLVKCAEKE
                 KTFCVNGGECF"
     exon          1200722..1201065
                 /gene="NRG1"
                 /number=7a
     CDS
join(1200824..1201065,1210623..1210744,1219543..1219593,
                 1221864..1221914,1332978..>1333105)
                 /gene="NRG1"
                 /codon_start=1
                 /product="pACF-68_45" (clone ACF-68_45)
/translation="MFLFERLPGDQSCFSFSFLLLALPPRLKEMKSQESAAGSKLVLR

CETSSEYSSLRFKWFKNGNELNRKNKPQNIKIQKKPGKSELRINKASLADSGEYMCKV

ISKLGNDSASANITIVESNEIITGMPASTEGAYVSSESPIRISVSTEGANTSSSTSTS

TTGTSHLVKCAEKEKTFCVNGGECFMVKDLSNPSRYLC"
     CDS
join(1200824..1201065,1210623..1210744,1332978..>1333105)
                 /gene="NRG1"
                 /codon_start=1
                 /product="pACF-69_52" (clone ACF-69_52)
/translation="MFLFERLPGDQSCFSFSFLLLALPPRLKEMKSQESAAGSKLVLR

CETSSEYSSLRFKWFKNGNELNRKNKPQNIKIQKKPGKSELRINKASLADSGEYMCKV

ISKLGNDSASANITIVESNATSTSTTGTSHLVKCAEKEKTFCVNGGECFMVKDLSNPS
                 RYLC"
     exon          1200888..1201065
                 /gene="NRG1"
                 /number=7b
     CDS
join(1200911..1201065,1210623..1210744,1332978..>1333066)
                 /gene="NRG1"
                 /codon_start=1
                 /product="pACF-3R_19" (clone ACF-3R_19) or "pSB-
                 9B-b_28"
                 (clone SB-9B-b_28)
                 /note="Clone SB-9B-b_28 differs from clone ACF-
                 3R_19 in
                 exon content at the 5' end, but encodes a protein
                 fragment
                 identical to clone ACF-3R_19."
/translation="MKSQESAAGSKLVLRCETSSEYSSLRFKWFKNGNELNRKNKPQN IKIQKKPGKSELRINKASLADSGEYMCKVISKLGNDSASANITIVESNATSTSTTGTS
                 HLVKCAEKEKTFCVNGGECF"
     CDS
join(<1200935..1201065,1210623..1210744,1219543..1219593,
                 1332978..1333107,1347707..1347800)
                 /gene="NRG1"
                 /codon_start=1
                 /product="pACF-2R_09" (clone ACF-2R_09)
/translation="GSKLVLRCETSSEYSSLRFKWFKNGNELNRKNKPQNIKIQKKPG
```

TABLE 1-continued

```
KSELRINKASLADSGEYMCKVISKLGNDSASANITIVESNEIITGMPASTEGAYVSSA

TSTSTTGTSHLVKCAEKEKTFCVNGGECFMVKDLSNPSRYLCKCPNEFTGDRCQNYVM
                ASFYSTSTPFLSLPE"
     CDS
join(<1200935..1201065,1210623..1210744,1332978..1333111)
                /gene="NRG1"
                /codon_start=1
                /product="pSB-6_16" (clone SB-6_16)
/translation="GSKLVLRCETSSEYSSLRFKWFKNGNELNRKNKPQNIKIQKKPG KSELRINKASLADSGEYMCKVISKLGNDSASANITIVESNATSTSTTGTSHLVKCAEK
                EKTFCVNGGECFMVKDLSNPSRYLCK"
     CDS
join(<1200935..1201065,1210623..1210744,1219543..1219593,
1221864..1221914,1332978..1333107,1347707..1347800)
                /gene="NRG1"
                /codon_start=1
                /product="pACF-1_06" (clone ACF-1_06)
/translation="GSKLVLRCETSSEYSSLRFKWFKNGNELNRKNKPQNIKIQKKPG

KSELRINKASLADSGEYMCKVISKLGNDSASANITIVESNEIITGMPASTEGAYVSSE

SPIRISVSTEGANTSSSTSTSTTGTSHLVKCAEKEKTFCVNGGECFMVKDLSNPSRYL
                CKCPNEFTGDRCQNYVMASFYSTSTPFLSLPE"
     CDS
join(<1200938..1201065,1210623..1210744,1332978..1333107,
                1347707..1347800)
                /gene="NRG1"
                /codon_start=1
                /product="pACF-1_03" (clone ACF-1_03)
/translation="SKLVLRCETSSEYSSLRFKWFKNGNELNRKNKPQNIKIQKKPGK

SELRINKASLADSGEYMCKVISKLGNDSASANITIVESNATSTSTTGTSHLVKCAEKE

KTFCVNGGECFMVKDLSNPSRYLCKCPNEFTGDRCQNYVMASFYSTSTPFLSLPE"
     CDS
join(<1200953..1201065,1210623..1210744,1219543..1219593,
1221864..1221914,1332978..1333107,1347707..1347765,
1354621..1354644,1359432..1359534,1361463..>1361571)
                /gene="NRG1"
                /codon_start=1
                /product="pACF-48R_22" (clone ACF-48R_22)
/translation="RCETSSEYSSLRFKWFKNGNELNRKNKPQNIKIQKKPGKSELRI

NKASLADSGEYMCKVISKLGNDSASANITIVESNEIITGMPASTEGAYVSSESPIRIS

VSTEGANTSSSTSTSTTGTSHLVKCAEKEKTFCVNGGECFMVKDLSNPSRYLCKCPNE

FTGDRCQNYVMASFYKHLGIEFMEAEELYQKRVLTITGICIALLVVGIMCVVAYCKTK
                KQRKKLHDRLRQSLRSERNNTMNIANGPHHPNPPPE"
     exon            1210623..1210744
                /gene="NRG1"
                /number=8
     CDS
join(<1210624..1210744,1219543..1219593,1221864..1221914,
1332978..1333107,1347707..1347765,1354621..1354644,
1359432..1359534,1361463..1361589,1364363..1364493,
                1365257..1365463,1368811..1369465)
                /gene="NRG1"
                /codon_start=1
                /product="Neu differentiation factor (partial)"
                //protein_id="AAA19953.1"
                /db_xref="GI:408407"
/translation="KSELRINKASLADSGEYMCKVISKLGNDSASANITIVESNEIIT

GMPASTEGAYVSSESPIRISVSTEGANTSSSTSTSTTGTSHLVKCAEKEKTFCVNGGE

CFMVKDLSNPSRYLCKCPNEFTGDRCQNYVMASFYKHLGIEFMEAEELYQKRVLTITG

ICIALLVVGIMCVVAYCKTKKQRKKLHDRLRQSLRSERNNTMNIANGPHHPNPPPENV

QLVNQYVSKNVISSEHIVEREAETSFSTSHYTSTAHHSTTVTQTPSHSWSNGHTESIL

SESHSVIVMSSVENSRHSSPTGGPRGRLNGTGGPRECNSFLRHARETPDSYRDSPHSE

RYVSAMTTPARMSPVDFHTPSSPKSPPSEMSPPVSSMTVSMPSMAVSPFMEEERPLLL

VTPPRLREKKFDHHPQQFSSFHHNPAHDSNSLPASPLRIVEDEEYETTQEYEPAQEPV
```

TABLE 1-continued

```
KKLANSRRAKRTKPNGHIANRLEVDSNTSSQSSNSESETEDERVGEDTPFLGIQNPLA
                   ASLEATPAFRLADSRTNPAGRFSTQEEIQARLSSVIANQDPIAV"
                   /note="This partial sequence of Neu
                   differentiation factor
                   differs from the one in Genbank (GI: 408407) at
                   residues 1
                   (K instead of A) 201 (T instead of M) and 326 (S
                   instead
                   of F)."
     CDS
join(<1210711..1210744,1219543..1219593,1221864..1221914,
1332978..1333107,1347040..1347107,1347707..1347750)
                   /gene="NRG1"
                   /codon_start=1
                   /product="Neu differentiation factor (partial)"
                   /protein_id="AAA19952.1"
                   /db_xref="GI:408405"
/translation="ASANITIVESNEIITGMPASTEGAYVSSESPIRISVSTEGANTS SSTSTSTTGTSHLVKCAEKEKTFCVNGGECFMVKDLSNPSRYLCKCQPGFTGARCTEN
                   VPMKVQNQESAQMSLLVIAAKTT"
     exon            1219543..1219593
                   /gene="NRG1"
                   /number=9
     exon            1221864..1221914
                   /gene="NRG1"
                   /number=10
     exon            1252254..1253413
                   /gene="NRG1"
                   /number=11
     CDS
join(1252747..1253413,1332978..1333107,1347707..1347800)
                   /gene="NRG1"
                   /codon_start=1
                   /product="heregulin (sensory and motor neuron-
                   derived
                   factor)"
                   /protein_id="AAC41764.1"
                   /dbp_xref="GI:862423"
/translation="MEIYSPDMSEVAAERSSSPSTQLSADPSLDGLPAAEDMPEPQTE

DGRTPGLVGLAVPCCACLEAERLRGCLNSEKICIVPILACLVSLCLCIAGLKWVFVDK

IFEYDSPTHLDPGGLGQDPIISLDATAASAVWVSSEAYTSPVSRAQSESEVQVTVQGD

KAVVSFEPSAAPTPKNRIFAFSFLPSTAPSFPSPTRNPEVRTPKSATQPQTTETNLQT

APKLSTSTSTTGTSHLVKCAEKEKTFCVNGGECFMVKDLSNPSRYLCKCPNEFTGDRC
                   QNYVMASFYSTSTPFLSLPE"
     CDS
join(<1253089..1253413,1332978..1333107,1347707..1347765,
                   1354621..1354644,1359432..>1359481)
                   /gene="NRG1"
                   /codon_start=1
                   /product="pACF-6_29" (clone ACF-6_29)
/translation="GGLGQDPIISLDATAASAVWVSSEAYTSPVSRAQSESEVQVTVQ

GDKAVVSFEPSAAPTPKNRIFAFSFLPSTAPSFPSPTRNPEVRTPKSATQPQTTETNL

QTAPKLSTSTSTTGTSHLVKCAEKEKTFCVNGGECFMVKDLSNPSRYLCKCPNEFTGD
                   RCQNYVMASFYKHLGIEFMEAEELYQKRVLTITGIC"
     CDS
join(<1253266..1253413,1332978..1333107,1347707..1347765,
                   1359432..>1359481)
                   /gene="NRG1"
                   /codon_start=1
                   /product="pSB-16A-c_61" (clone SB-16A-c_61)
/translation="PKNRIFAFSFLPSTAPSFPSPTRNPEVRTPKSATQPQTTETNLQ TAPKLSTSTSTTGTSHLVKCAEKEKTFCVNGGECFMVKDLSNPSRYLCKCPNEFTGDR
                   CQNYVMASFYKAEELYQKRVLTITGIC"
     CDS
join(<1253347..1253413,1332978..1333107,1347707..1347765,
                   1359432..>1359532)
                   /gene="NRG1"
                   /codon_start=1
                   /product="pACF-20_09" (clone ACF-20_09)
/translation="RTPKSATQPQTTETNLQTAPKLSTSTSTTGTSHLVKCAEKEKTF
```

TABLE 1-continued

```
CVNGGECFMVKDLSNPSRYLCKCPNEFTGDRCQNYVMASFYKAEELYQKRVLTITGIC
                    IALLVVGIMCVVAYCKT"
     exon            1326782..1327071
                    /gene="NRG1"
                    /number=12
     CDS
join(<1327011..1327071,1332978..1333107,1347040..1347107,
                    1359432..>1359475)
                    /gene="NRG1"
                    /codon_start=1
                    /product="pSB-18A-a_74" (clone SB-18A-a_74)
/translation="DFKEQESMQIPKHISIEDITATSTSTTGTSHLVKCAEKEKTFCV

NGGECFMVKDLSNPSRYLCKCQPGFTGARCTENVPMKVQNQEKAEELYQKRVLTITG"

CDS
join(1327032..1327071,1332978..1333107,1347707..1347765,
                    1354621..1354644,1359432..>1359481)
                    /gene="NRG1"
                    /codon_start=1
                    /product="pACF-6_28" (clone ACF-6_28)
/translation="MQIPKHISIEDITATSTSTTGTSHLVKCAEKEKTFCVNGGECFM VKDLSNPSRYLCKCPNEFTGDRCQNYVMASFYKHLGIEFMEAEELYQKRVLTITGIC"
     CDS             join(1327032..1327071,1347707..1347750)
                    /gene="NRG1"
                    /codon_start=1
                    /product="pACF-10_41" (clone ACF-10_41)
                    /translation="MQIPKHISIEDITGAQMSLLVIAAKTT"
     exon            1332978..1333107
                    /gene="NRG1"
                    /number=13a
     exon            1332978..1333652
                    /gene="NRG1"
                    /number=13b
     CDS             join(<1333055..1333107,1347040..1347107,
                    1354621..1354644,
                    1359432..1359534,
                    1361463..1361589,1364363..1364493,
                    1365257..1365463,1368811..>1369147)
                    /gene="NRG1"
                    /codon_start=1
                    /product="Neu differentiation factor (partial)"
                    /protein_id="AAA19950.1"
                    /db_xref="GI:408401"
/translation="GECFMVKDLSNPSRYLCKCQPGFTGARCTENVPMKVQNQEKHLG

IEFMEAEELYQKRVLTITGICIALLVVGIMCVVAYCKTKKQRKKLHDRLRQSLRSERN

NTMNIANGPHHPNPPPENVQLVNQYVSKNVISSEHIVEREAETSFSTSHYTSTAHHST

TVTQTPSHSWSNGHTESILSESHSVIVMSSVENSRHSSPTGGPRGRLNGTGGPRECNS

FLRHARETPDSYRDSPHSERYVSAMTTPARMSPVDFHTPSSPKSPPSEMSPPVSSMTV

SMPSMAVSPFMEEERPLLLVTPPRLREKKFDHHPQQFSSFHHNPAHDSNSLPASPLRI
                    VEDEEYETTQEYEPAQ"
                    /note="This partial sequence of Neu
                    differentiation factor
                    differs from the Genbank one (GI: 408401) at
                    residues 48
                    (M instead of I), 104 (T instead of M) and 350 (Q
                    instead
                    of R)."
     exon            1347040..1347107
                    /gene="NRG1"
                    /number=14
     exon            1347707..1347765
                    /gene="NRG1"
                    /number=15a
     exon            1347707..1348257
                    /gene="NRG1"
                    /number=15b
     exon            1354621..1354644
                    /gene="NRG1"
                    /number=16
```

TABLE 1-continued

```
        exon            1359432..1359534
                        /gene="NRG1"
                        /number=17
        CDS
join(1359506..1359534,1361463..1361589,1364363..1364493,
                        1365257..1365467)
                        /gene="NRG1"
                        /codon_start=1
                        /product="pACF-2_11" (clone ACF-2_11)
/translation="MCVVAYCKTKKQRKKLHDRLRQSLRSERNNTMNIANGPHHPNPP

PENVQLVNQYVSKNVISSEHIVEREAETSFSTSHYTSTAHHSTTVTQTPSHSWSNGHT

ESILSESHSVIVMSSVENSRHSSPTGGPRGRLNGTGGPRECNSFLRHARETPDSYRDS
                        PHSER"
        exon            1361463..1361589
                        /gene="NRG1"
                        /number=18
        exon            1364363..1364493
                        /gene="NRG1"
                        /number=19
        exon            1365257..1365463
                        /gene="NRG1"
                        /number=20a
        exon            1365257..1366044
                        /gene="NRG1"
                        /number=20b
        exon            1368281..1368422
                        /gene="NRG1"
                        /number=21
        exon            1368811..1369656
                        /gene="NRG1"
                        /number=22
```

TABLE 2

Microsatellites, SNP's, and insertions/deletions in the 1.5 Mb sequence.

i) Previously known microsatellite markers in the 1.5 Mb sequence are:

D8S171                                  Accession number: GDB:605902
D8S2319                                 Accession number: GDB:1298416
D8S1810                                 Accession number: GDB:613185
D8S1125                                 Accession number: GDB:684228
D8S1477                                 Accession number: GDB:686004
D8S278                                  Accession number: GDB:188295 ii) Novel polymorphic microsatellite markers in the 1.5 Mb sequence are:

Marker                  base nr

29H12-1                 16369-16598
F: CAGTTCTGGAAACTTTTCTGTGTG              SEQ ID NO:40
R: CAGATCCACAAGTTCTACAATAGCA             SEQ ID NO:41
29H12-7320              21839-21955
F: TTTTCTTTACTGGTGCTCTCTAGTGT            SEQ ID NO:42
R: TGCAGGCATAGAATTCTCCA                  SEQ ID NO:43
29H12-123E24            69332-69206
F: GAGTAGTTGGGACTACAGATGCACAC            SEQ ID NO:44
R: CAGCTTGGGCAAGAAAGTAAG                 SEQ ID NO:45
29H12-2                 70671-70830
F: CTCAAA7ITITGGGGGCTCAC                 SEQ ID NO:46
R: CAATATTATACAATTTCTGGCAGCAT            SEQ ID NO:47
29H12-121L21            136728-136926
F: ATACTGAAGGGCAGGGGTITT                 SEQ ID NO:48
R: ATFITTTCTGGGTGATFITTCCTCATT           SEQ ID NO:49
450K14-72458            215725-215881
F: AGGCTTCTGGACCCTCAAAT                  SEQ ID NO:50
R: CTCAGCTTTGCCCTCTGAAT                  SEQ ID NO:51
478B14-642              240205-240451
F: AGGGCAGGAACCTTTCATCT                  SEQ ID NO:52
R: TAGCGAGAAAGTTGGGGAGA                  SEQ ID NO:53
487-2                   317814-318014
F: AGTGAGTAGGGCTGGCTGCT                  SEQ ID NO:54
R: GCTGCTAATATGGCCCCTTC                  SEQ ID NO:55
478B14-848              336198-336417
F: GCACATGTCCAACTGAAGAGG                 SEQ ID NO:56
```

TABLE 2-continued

Microsatellites, SNP's, and insertions/deletions in the 1.5 Mb sequence.

| | | |
|---|---|---|
| R: TCTCCATGTGTAAAACAATACATATCA | | SEQ ID NO:57 |
| 420M9-1395 | 412817-413095 | |
| F: CTTTTAATCATGAAAGAATAGCAAAAA | | SEQ ID NO:58 |
| R: TGTGTTGTATATTTCAGAATTTCCTT | | SEQ ID NO:59 |
| 420M9-1 | 435175-435396 | |
| GGCATGTCCCAATTTGGTT | | SEQ ID NO:60 |
| TGTCCCAGCTGATCTAAGCA | | SEQ ID NO:61 |
| 420M9-3663 | 449780-450121 | |
| F: GAGTTTTGAGGATCCTAGAGCAA | | SEQ ID NO:62 |
| R: GAAGGGCTAAAAGGAGAATTCATA | | SEQ ID NO:63 |
| 420M9-116I12 | 472938-473197 | |
| F: TTTGCTTATGGTGTCATTCTTTC | | SEQ ID NO:64 |
| R: GGAGTTCGTGGGTTCTAATCTC | | SEQ ID NO:65 |
| 420M9-14377 | 526307-526642 | |
| F: CCACAGCATGCAAAATGAAC | | SEQ ID NO:66 |
| R: TGTAGGATGCCAAGGAGGTT | | SEQ ID NO:67 |
| 473C15-533 | 581585-581741 | |
| F: GGCAGCAATACAAACACAGC | | SEQ ID NO:68 |
| R: CTAGGGTCAATGGGTGAGGA | | SEQ ID NO:69 |
| 473C15-439 | 647726-648013 | |
| F: TTTGGGATGTTTCAGGCATT | | SEQ ID NO:70 |
| R: TGGAAGGGTCGATGAAAGTG | | SEQ ID NO:71 |
| 72H22-1 | 684024-684174 | |
| AGAAGCAAGGATCCCCAGTT | | SEQ ID NO:72 |
| GCAAACATAAAGTATGACCCCTTG | | SEQ ID NO:73 |
| 82H10-79B8 | 761958-762080 | |
| F: ACATTGCCTCCAACCAAGTC | | SEQ ID NO:74 |
| R: CAGGTATGAGCCACCTCTCC | | SEQ ID NO:75 |
| 72H22-36 | 798203-798323 | |
| F: TGGAGCAGTAGTGACCGTGT | | SEQ ID NO:76 |
| R: ATCACCGTGACACTGAGGAGA | | SEQ ID NO:77 |
| 244L21-750 | 826723-827056 | |
| F: GGCCTGGAAAAAGTGTGTGT | | SEQ ID NO:78 |
| R: GCGCGTGAATCTCTTGTGTT | | SEQ ID NO:79 |
| 244L21-8557 | 912541-912691 | |
| F: GCAACTTGATGCCTGTAGCA | | SEQ ID NO:80 |
| R: CACCCTGTGAAAATGGCTCT | | SEQ ID NO:81 |
| 244L21-170889 | 49194-949478 | |
| F: GGTTCTTCGAAATGGCAAGT | | SEQ ID NO:82 |
| R: GGCGAGCAGAGTGAGACAC | | SEQ ID NO:83 |
| 225C17-1 | 1012241-1012388 | |
| F: TCTGTGACGCAATTCAATGAT | | SEQ ID NO:84 |
| R: ACCAGCCTGGCTTTAAAACAT | | SEQ ID NO:85 |
| 225C17-3 | 1051863-1052153 | |
| F: GCAAAGCTTCTCCAGACTCC | | SEQ ID NO:86 |
| R: AACCTGGAGGTTCAAGTGGA | | SEQ ID NO:87 |
| 225C17-4 | 1087296-1087572 | |
| F: TGTCACTATGGCCCACTGAA | | SEQ ID NO:88 |
| R: GAAAAGCATGGCAGATTTGA | | SEQ ID NO:89 |
| 317J8-2123 | 1130273-1130517 | |
| F: CCCAGAAAGCAGGCAAGTAG | | SEQ ID NO:90 |
| R: CATGAAAAAGACGCAAGCAA | | SEQ ID NO:91 |
| 317J8-1 | 1152587-1152721 | |
| F: CCCTTAGAAGAGGCCAGGTT | | SEQ ID NO:92 |
| R: AGGTTGCGCTCTCCTGCT | | SEQ ID NO:93 |
| 317J8-2 | 1205197-1205453 | |
| F: TTAGCCAAGCACAGTGGTGT | | SEQ ID NO:94 |
| R: TTGGTTCCCTGAGCCCTAA | | SEQ ID NO:95 |
| 317J8-4858 | 1245572-1245761 | |
| F: ACAGGAAGACTGCCATTTGC | | SEQ ID NO:96 |
| R: AAGCCTTTGCTCATGTTCTCA | | SEQ ID NO:97 |
| S8S61144 | 1353342-1353494 | |
| F: AAATTTCATGATGCGGAAGG | | SEQ ID NO:98 |
| R: ACGCTTTTTGACCACACACA | | SEQ ID NO:99 |
| S8S4792 | 1366527-1366755 | |
| F: CCCATGGAACTACCACACAA | | SEQ ID NO:100 |
| R: AGGGCCTTTCCTTCAAAATG | | SEQ ID NO:101 |
| S8S1765 | 1477309-1477601 | |
| F: AAGCAGCAGGCAAAATGAGT | | SEQ ID NO:102 |
| R: GATGCAAAGGCAAGTCCAGT | | SEQ ID NO:103 |
| iii) Single nucleotide polymorphisms in exons: | | |
| a) NRG1 exon | | |
| E1006A | | SEQ ID NO:104 |
| E592A | | SEQ ID NO:105 |
| E178A | | SEQ ID NO:106 |

TABLE 2-continued

Microsatellites, SNP's, and insertions/deletions in the 1.5 Mb sequence.

| | |
|---|---|
| E51Aa | SEQ ID NO:107 |
| E1160A | SEQ ID NO:108 |
| E675A | SEQ ID NO:109 |
| E103A | SEQ ID NO:110 |
| E127A | SEQ ID NO:111 |
| E846A | SEQ ID NO:112 |
| b) NRG1AG1 exon | |
| E558B | SEQ ID NO:113 |
| E178B | SEQ ID NO:114 |
| E262B | SEQ ID NO:115 |
| iv) Single nucleotide polymorphisms in the 1.5 Mb sequence: | |
| >SNP8NRG60__allelePos=60 total len = 260 SNP=Y chr8 | SEQ ID NO:116 |
| >SNP8NRG179__allelePos=179 total len = 379 SNP=W chr8 | SEQ ID NO:117 |
| >SNP8NRG397__allelePos=201 total len = 401 SNP=R chr8 | SEQ ID NO:118 |
| >SNP8NRG410__allelePos=201 total len = 401 SNP=R chr8 | SEQ ID NO:119 |
| >SNP8NRG653__allelePos=201 total len = 401 SNP=W chr8 | SEQ ID NO:120 |
| >SNP8NRG1672__allelePos=201 total len = 401 SNP=Y chr8 | SEQ ID NO:121 |
| >SNP8NRG1959__allelePos=201 total len = 401 SNP=Y chr8 | SEQ ID NO:122 |
| >SNP8NRG2464__allelePos=201 total len = 401 SNP=R chr8 | SEQ ID NO:123 |
| >SNP8NRG4446__allelePos=201 total len = 401 SNP=M chr8 | SEQ ID NO:124 |
| >SNP8NRG4463__allelePos=201 total len = 401 SNP=Y chr8 | SEQ ID NO:125 |
| >SNP8NRG4580__allelePos=201 total len = 401 SNP=S chr8 | SEQ ID NO:126 |
| >SNP8NRG5461__allelePos=201 total len = 401 SNP=Y chr8 | SEQ ID NO:127 |
| >SNP8NRG5893__allelePos=201 total len = 401 SNP=W chr8 | SEQ ID NO:128 |
| >SNP8NRG6597__allelePos=201 total len = 401 SNP=R chr8 | SEQ ID NO:129 |
| >SNP8NRG6662__allelePos=201 total len = 401 SNP=R chr8 | SEQ ID NO:130 |
| >SNP8NRG6787__allelePos=201 total len = 401 SNP=S chr8 | SEQ ID NO:131 |
| >SNP8NRG6844__allelePos=201 total len = 401 SNP=Y chr8 | SEQ ID NO:132 |
| SNP8NRG7475__allelePos=201 total len = 401 SNP=Y chr8 | SEQ ID NO:133 |
| >SNP8NRG7519__allelePos=201 total len = 401 SNP=R chr8 | SEQ ID NO:134 |
| >SNP8NRG8707__allelePos=201 total len = 401 SNP=Y chr8 | SEQ ID NO:135 |
| >SNP8NRG8841__allelePos=201 total len = 401 SNP=R chr8 | SEQ ID NO:136 |
| >SNP8NRG9062__allelePos=201 total len = 401 SNP=Y chr8 | SEQ ID NO:137 |
| >SNP8NRG9085__allelePos=201 total len = 401 SNP=R chr8 | SEQ ID NO:138 |
| >SNP8NRG9101__allelePos=201 total len = 401 SNP=M chr8 | SEQ ID NO:139 |
| >SNP8NRG10174__allelePos=201 total len = 401 SNP=Y chr8 | SEQ ID NO:140 |
| >SNP8NRG10497__allelePos=201 total len = 401 SNP=Y chr8 | SEQ ID NO:141 |
| >SNP8NRG10687__allelePos=201 total len = 401 SNP=W chr8 | SEQ ID NO:142 |
| >SNP8NRG11026__allelePos=201 total len = 401 SNP=S chr8 | SEQ ID NO:143 |
| >SNP8NRG11116__allelePos=201 total len = 401 SNP=R chr8 | SEQ ID NO:144 |
| >SNP8NRG11189__allelePos=201 total len = 401 SNP=R chr8 | SEQ ID NO:145 |
| >SNP8NRG11306__allelePos=201 total len = 401 SNP=Y chr8 | SEQ ID NO:146 |
| >SNP8NRG11453__allelePos=201 total len = 401 SNP=W chr8 | SEQ ID NO:147 |
| >SNP8NRG11816__allelePos=201 total len = 401 SNP=R chr8 | SEQ ID NO:148 |
| >SNP8NRG12009__allelePos=201 total len = 401 SNP=K chr8 | SEQ ID NO:149 |
| >SNP8NRG12264__allelePos=201 total len = 401 SNP=R chr8 | SEQ ID NO:150 |
| >SNP8NRG12867__allelePos=201 total len = 401 SNP=Y chr8 | SEQ ID NO:151 |
| >SNP8NRG13358__allelePos=201 total len = 401 SNP=Y chr8 | SEQ ID NO:152 |
| >SNP8NRG15643__allelePos=201 total len = 401 SNP=R chr8 | SEQ ID NO:153 |
| >SNP8NRG15645__allelePos=201 total len = 401 SNP=M chr8 | SEQ ID NO:154 |
| >SNP8NRG15804__allelePos=201 total len = 401 SNP=Y chr8 | SEQ ID NO:155 |
| >SNP8NRG18233__allelePos=201 total len = 401 SNP=W chr8 | SEQ ID NO:156 |
| >SNP8NRG19871__allelePos=201 total len = 401 SNP=R chr8 | SEQ ID NO:157 |
| >SNP8NRG20056__allelePos=201 total len = 401 SNP=R chr8 | SEQ ID NO:158 |
| >SNP8NRG20969__allelePos=201 total len = 401 SNP=R chr8 | SEQ ID NO:159 |
| >SNP8NRG21091__allelePos=201 total len = 401 SNP=M chr8 | SEQ ID NO:160 |
| >SNP8NRG24917__allelePos=201 total len = 401 SNP=Y chr8 | SEQ ID NO:161 |
| >SNP8NRG26481__allelePos=201 total len = 401 SNP=R chr8 | SEQ ID NO:162 |
| >SNP8NRG26580__allelePos=201 total len = 401 SNP=R chr8 | SEQ ID NO:163 |
| >SNP8NRG28434__allelePos=201 total len = 401 SNP=R chr8 | SEQ ID NO:164 |
| >SNP8NRG28440__allelePos=201 total len = 401 SNP=Y chr8 | SEQ ID NO:165 |
| >SNP8NRG29152__allelePos=201 total len = 401 SNP=Y chr8 | SEQ ID NO:166 |
| >SNP8NRG30168__allelePos=201 total len = 401 SNP=Y chr8 | SEQ ID NO:167 |
| >SNP8NRG30176__allelePos=201 total len = 401 SNP=Y chr8 | SEQ ID NO:168 |
| >SNP8NRG31792__allelePos=201 total len = 401 SNP=W chr8 | SEQ ID NO:169 |
| >SNP8NRG34543__allelePos=201 total len = 401 SNP=Y chr8 | SEQ ID NO:170 |
| >SNP8NRG35406__allelePos=201 total len = 401 SNP=W chr8 | SEQ ID NO:171 |
| >SNP8NRG37394__allelePos=201 total len = 401 SNP=M chr8 | SEQ ID NO:172 |
| >SNP8NRG41184__allelePos=201 total len = 401 SNP=Y chr8 | SEQ ID NO:173 |
| >SNP8NRG41634__allelePos=201 total len = 401 SNP=Y chr8 | SEQ ID NO:174 |
| >SNP8NRG42449__allelePos=201 total len = 401 SNP=R chr8 | SEQ ID NO:175 |
| >SNP8NRG44643__allelePos=201 total len = 401 SNP=R chr8 | SEQ ID NO:176 |
| >SNP8NRG45727__allelePos=201 total len = 401 SNP=Y chr8 | SEQ ID NO:177 |
| >SNP8NRG49500__allelePos=201 total len = 401 SNP=R chr8 | SEQ ID NO:178 |
| >SNP8NRG50772__allelePos=201 total len = 401 SNP=Y chr8 | SEQ ID NO:179 |

TABLE 2-continued

Microsatellites, SNP's, and insertions/deletions in the 1.5 Mb sequence.

| | |
|---|---|
| >SNP8NRG51243__allelePos=201 total len = 401 SNP=Y chr8 | SEQ ID NO:180 |
| >SNP8NRG51606__allelePos=201 total len = 401 SNP=S chr8 | SEQ ID NO:181 |
| >SNP8NRG52942__allelePos=201 total len = 401 SNP=Y chr8 | SEQ ID NO:182 |
| >SNP8NRG54357__allelePos=201 total len = 401 SNP=W chr8 | SEQ ID NO:183 |
| >SNP8NRG54532__allelePos=201 total len = 401 SNP=S chr8 | SEQ ID NO:184 |
| >SNP8NRG58041__allelePos=201 total len = 401 SNP=R chr8 | SEQ ID NO:185 |
| >SNP8NRG59140__allelePos=201 total len = 401 SNP=W chr8 | SEQ ID NO:186 |
| >SNP8NRG59214__allelePos=201 total len = 401 SNP=M chr8 | SEQ ID NO:187 |
| >SNP8NRG60484__allelePos=201 total len = 401 SNP=S chr8 | SEQ ID NO:188 |
| >SNP8NRG60920__allelePos=201 total len = 401 SNP=Y chr8 | SEQ ID NO:189 |
| >SNP8NRG62524__allelePos=201 total len = 401 SNP=Y chr8 | SEQ ID NO:190 |
| >SNP8NRG62537__allelePos=201 total len = 401 SNP=Y chr8 | SEQ ID NO:191 |
| >SNP8NRG62674__allelePos=201 total len = 401 SNP=Y chr8 | SEQ ID NO:192 |
| >SNP8NRG63383__allelePos=201 total len = 401 SNP=R chr8 | SEQ ID NO:193 |
| >SNP8NRG63548__allelePos=201 total len = 401 SNP=K chr8 | SEQ ID NO:194 |
| >SNP8NRG64088__allelePos=201 total len = 401 SNP=W chr8 | SEQ ID NO:195 |
| >SNP8NRG68231__allelePos=201 total len = 401 SNP=S chr8 | SEQ ID NO:196 |
| >SNP8NRG68601__allelePos=201 total len = 401 SNP=K chr8 | SEQ ID NO:197 |
| >SNP8NRG69266__allelePos=201 total len = 401 SNP=R chr8 | SEQ ID NO:198 |
| >SNP8NRG72685__allelePos=201 total len = 401 SNP=M chr8 | SEQ ID NO:199 |
| >SNP8NRG73520__allelePos=201 total len = 401 SNP=Y chr8 | SEQ ID NO:200 |
| >SNP8NRG79184__allelePos=201 total len = 401 SNP=S chr8 | SEQ ID NO:201 |
| >SNP8NRG80068__allelePos=201 total len = 401 SNP=Y chr8 | SEQ ID NO:202 |
| >SNP8NRG80895__allelePos=201 total len = 401 SNP=W chr8 | SEQ ID NO:203 |
| >SNP8NRG85217__allelePos=201 total len = 401 SNP=S chr8 | SEQ ID NO:204 |
| >SNP8NRG86326__allelePos=201 total len = 401 SNP=M chr8 | SEQ ID NO:205 |
| >SNP8NRG86768__allelePos=201 total len = 401 SNP=R chr8 | SEQ ID NO:206 |
| >SNP8NRG87893__allelePos=201 total len = 401 SNP=W chr8 | SEQ ID NO:207 |
| >SNP8NRG88520__allelePos=201 total len = 401 SNP=Y chr8 | SEQ ID NO:208 |
| >SNP8NRG88820__allelePos=201 total len = 401 SNP=R chr8 | SEQ ID NO:209 |
| >SNP8NRG89613__allelePos=201 total len = 401 SNP=Y chr8 | SEQ ID NO:210 |
| >SNP8NRG89692__allelePos=201 total len = 401 SNP=Y chr8 | SEQ ID NO:211 |
| >SNP8NRG89722__allelePos=201 total len = 401 SNP=S chr8 | SEQ ID NO:212 |
| >SNP8NRG89835__allelePos=201 total len = 401 SNP=Y chr8 | SEQ ID NO:213 |
| >SNP8NRG90059__allelePos=201 total len = 401 SNP=R chr8 | SEQ ID NO:214 |
| >SNP8NRG90379__allelePos=201 total len = 401 SNP=K chr8 | SEQ ID NO:215 |
| >SNP8NRG90385__allelePos=201 total len = 401 SNP=S chr8 | SEQ ID NO:216 |
| >SNP8NRG90389__allelePos=201 total len = 401 SNP=Y chr8 | SEQ ID NO:217 |
| >SNP8NRG90559__allelePos=201 total len = 401 SNP=Y chr8 | SEQ ID NO:218 |
| >SNP8NRG91128__allelePos=201 total len = 401 SNP=R chr8 | SEQ ID NO:219 |
| >SNP8NRG91178__allelePos=201 total len = 401 SNP=R chr8 | SEQ ID NO:220 |
| >SNP8NRG91814__allelePos=201 total len = 401 SNP=Y chr8 | SEQ ID NO:221 |
| >SNP8NRG92080__allelePos=201 total len = 401 SNP=S chr8 | SEQ ID NO:222 |
| >SNP8NRG92366__allelePos=201 total len = 401 SNP=R chr8 | SEQ ID NO:223 |
| >SNP8NRG92986__allelePos=201 total len = 401 SNP=K chr8 | SEQ ID NO:224 |
| >SNP8NRG93253__allelePos=201 total len = 401 SNP=K chr8 | SEQ ID NO:225 |
| >SNP8NRG93675__allelePos=201 total len = 401 SNP=Y chr8 | SEQ ID NO:226 |
| >SNP8NRG94052__allelePos=201 total len = 401 SNP=Y chr8 | SEQ ID NO:227 |
| >SNP8NRG94333__allelePos=201 total len = 401 SNP=R chr8 | SEQ ID NO:228 |
| >SNP8NRG94423__allelePos=201 total len = 401 SNP=Y chr8 | SEQ ID NO:229 |
| >SNP8NRG94601__allelePos=201 total len = 401 SNP=Y chr8 | SEQ ID NO:230 |
| >SNP8NRG94623__allelePos=201 total len = 401 SNP=K chr8 | SEQ ID NO:231 |
| >SNP8NRG95023__allelePos=201 total len = 401 SNP=Y chr8 | SEQ ID NO:232 |
| >SNP8NRG95049__allelePos=201 total len = 401 SNP=S chr8 | SEQ ID NO:233 |
| >SNP8NRG95238__allelePos=201 total len = 401 SNP=R chr8 | SEQ ID NO:234 |
| >SNP8NRG95632__allelePos=201 total len = 401 SNP=R chr8 | SEQ ID NO:235 |
| >SNP8NRG95660__allelePos=201 total len = 401 SNP=R chr8 | SEQ ID NO:236 |
| >SNP8NRG96256__allelePos=201 total len = 401 SNP=Y chr8 | SEQ ID NO:237 |
| >SNP8NRG96258__allelePos=201 total len = 401 SNP=Y chr8 | SEQ ID NO:238 |
| >SNP8NRG96304__allelePos=201 total len = 401 SNP=Y chr8 | SEQ ID NO:239 |
| >SNP8NRG96837__allelePos=201 total len = 401 SNP=R chr8 | SEQ ID NO:240 |
| >SNP8NRG97323__allelePos=201 total len = 401 SNP=K chr8 | SEQ ID NO:241 |
| >SNP8NRG97462__allelePos=201 total len = 401 SNP=Y chr8 | SEQ ID NO:242 |
| >SNP8NRG97535__allelePos=201 total len = 401 SNP=R chr8 | SEQ ID NO:243 |
| >SNP8NRG97919__allelePos=201 total len = 401 SNP=S chr8 | SEQ ID NO:244 |
| >SNP8NRG98037__allelePos=201 total len = 401 SNP=R chr8 | SEQ ID NO:245 |
| >SNP8NRG98839__allelePos=201 total len = 401 SNP=R chr8 | SEQ ID NO:246 |
| >SNP8NRG99868__allelePos=201 total len = 401 SNP=R chr8 | SEQ ID NO:247 |
| >SNP8NRG99869__allelePos=201 total len = 401 SNP=R chr8 | SEQ ID NO:248 |
| >SNP8NRG100779__allelePos=201 total len = 401 SNP=W chr8 | SEQ ID NO:249 |
| >SNP8NRG100833__allelePos=201 total len = 401 SNP=Y chr8 | SEQ ID NO:250 |
| >SNP8NRG100857__allelePos=201 total len = 401 SNP=Y chr8 | SEQ ID NO:251 |
| >SNP8NRG101112__allelePos=201 total len = 401 SNP=Y chr8 | SEQ ID NO:252 |
| >SNP8NRG101613__allelePos=201 total len = 401 SNP=R chr8 | SEQ ID NO:253 |
| >SNP8NRG101730__allelePos=201 total len = 401 SNP=R chr8 | SEQ ID NO:254 |
| >SNP8NRG101822__allelePos=201 total len = 401 SNP=Y chr8 | SEQ ID NO:255 |
| >SNP8NRG102260__allelePos=201 total len = 401 SNP=S chr8 | SEQ ID NO:256 |

TABLE 2-continued

Microsatellites, SNP's, and insertions/deletions in the 1.5 Mb sequence.

| | |
|---|---|
| >SNP8NRG102914__allelePos=201 total len = 401 SNP=R chr8 | SEQ ID NO:257 |
| >SNP8NRG103471__allelePos=201 total len = 401 SNP=W chr8 | SEQ ID NO:258 |
| >SNP8NRG104188__allelePos=201 total len = 401 SNP=Y chr8 | SEQ ID NO:259 |
| >SNP8NRG104511__allelePos=201 total len = 401 SNP=Y chr8 | SEQ ID NO:260 |
| >SNP8NRG104656__allelePos=201 total len = 401 SNP=M chr8 | SEQ ID NO:261 |
| >SNP8NRG105171__allelePos=201 total len = 401 SNP=W chr8 | SEQ ID NO:262 |
| >SNP8NRG105682__allelePos=201 total len = 401 SNP=R chr8 | SEQ ID NO:263 |
| >SNP8NRG105709__allelePos=201 total len = 401 SNP=R chr8 | SEQ ID NO:264 |
| >SNP8NRG105754__allelePos=201 total len = 401 SNP=W chr8 | SEQ ID NO:265 |
| >SNP8NRG107648__allelePos=201 total len = 401 SNP=Y chr8 | SEQ ID NO:266 |
| >SNP8NRG107724__allelePos=201 total len = 401 SNP=K chr8 | SEQ ID NO:267 |
| >SNP8NRG108240__allelePos=201 total len = 401 SNP=Y chr8 | SEQ ID NO:268 |
| >SNP8NRG109187__allelePos=201 total len = 401 SNP=K chr8 | SEQ ID NO:269 |
| >SNP8NRG109573__allelePos=201 total len = 401 SNP=Y chr8 | SEQ ID NO:270 |
| >SNP8NRG109902__allelePos=201 total len = 401 SNP=K chr8 | SEQ ID NO:271 |
| >SNP8NRG110341__allelePos=201 total len = 401 SNP=M chr8 | SEQ ID NO:272 |
| >SNP8NRG111192__allelePos=201 total len = 401 SNP=Y chr8 | SEQ ID NO:273 |
| >SNP8NRG112369__allelePos=201 total len = 401 SNP=Y chr8 | SEQ ID NO:274 |
| >SNP8NRG112601__allelePos=201 total len = 401 SNP=W chr8 | SEQ ID NO:275 |
| >SNP8NRG112715__allelePos=201 total len = 401 SNP=W chr8 | SEQ ID NO:276 |
| >SNP8NRG113225__allelePos=201 total len = 401 SNP=R chr8 | SEQ ID NO:277 |
| >SNP8NRG113961__allelePos=201 total len = 401 SNP=R chr8 | SEQ ID NO:278 |
| >SNP8NRG114283__allelePos=201 total len = 401 SNP=S chr8 | SEQ ID NO:279 |
| >SNP8NRG114425__allelePos=201 total len = 401 SNP=R chr8 | SEQ ID NO:280 |
| >SNP8NRG114558__allelePos=201 total len = 401 SNP=W chr8 | SEQ ID NO:281 |
| >SNP8NRG114765__allelePos=201 total len = 401 SNP=M chr8 | SEQ ID NO:282 |
| >SNP8NRG114983__allelePos=201 total len = 401 SNP=Y chr8 | SEQ ID NO:283 |
| >SNP8NRG115195__allelePos=201 total len = 401 SNP=Y chr8 | SEQ ID NO:284 |
| >SNP8NRG115591__allelePos=201 total len = 401 SNP=K chr8 | SEQ ID NO:285 |
| >SNP8NRG115659__allelePos=201 total len = 401 SNP=W chr8 | SEQ ID NO:286 |
| >SNP8NRG115667__allelePos=201 total len = 401 SNP=M chr8 | SEQ ID NO:287 |
| >SNP8NRG116534__allelePos=201 total len = 401 SNP=Y chr8 | SEQ ID NO:288 |
| >SNP8NRG117073__allelePos=201 total len = 401 SNP=Y chr8 | SEQ ID NO:289 |
| >SNP8NRG117083__allelePos=201 total len = 401 SNP=Y chr8 | SEQ ID NO:290 |
| >SNP8NRG117604__allelePos=201 total len = 401 SNP=K chr8 | SEQ ID NO:291 |
| >SNP8NRG117831__allelePos=201 total len = 401 SNP=Y chr8 | SEQ ID NO:292 |
| >SNP8NRG118982__allelePos=201 total len = 401 SNP=Y chr8 | SEQ ID NO:293 |
| >SNP8NRG119101__allelePos=201 total len = 401 SNP=R chr8 | SEQ ID NO:294 |
| >SNP8NRG119171__allelePos=201 total len = 401 SNP=M chr8 | SEQ ID NO:295 |
| >SNP8NRG119275__allelePos=201 total len = 401 SNP=W chr8 | SEQ ID NO:296 |
| >SNP8NRG119328__allelePos=201 total len = 401 SNP=R chr8 | SEQ ID NO:297 |
| >SNP8NRG120000__allelePos=201 total len = 401 SNP=Y chr8 | SEQ ID NO:298 |
| >SNP8NRG120293__allelePos=201 total len = 401 SNP=Y chr8 | SEQ ID NO:299 |
| >SNP8NRG121195__allelePos=201 total len = 401 SNP=M chr8 | SEQ ID NO:300 |
| >SNP8NRG121808__allelePos=201 total len = 401 SNP=Y chr8 | SEQ ID NO:301 |
| >SNP8NRG121885__allelePos=201 total len = 401 SNP=R chr8 | SEQ ID NO:302 |
| >SNP8NRG122038__allelePos=201 total len = 401 SNP=S chr8 | SEQ ID NO:303 |
| >SNP8NRG122384__allelePos=201 total len = 401 SNP=R chr8 | SEQ ID NO:304 |
| >SNP8NRG122422__allelePos=201 total len = 401 SNP=K chr8 | SEQ ID NO:305 |
| >SNP8NRG122462__allelePos=201 total len = 401 SNP=R chr8 | SEQ ID NO:306 |
| >SNP8NRG122634__allelePos=201 total len = 401 SNP=S chr8 | SEQ ID NO:307 |
| >SNP8NRG123153__allelePos=201 total len = 401 SNP=S chr8 | SEQ ID NO:308 |
| >SNP8NRG123455__allelePos=201 total len = 401 SNP=M chr8 | SEQ ID NO:309 |
| >SNP8NRG123986__allelePos=201 total len = 401 SNP=R chr8 | SEQ ID NO:310 |
| >SNP8NRG124030__allelePos=201 total len = 401 SNP=Y chr8 | SEQ ID NO:311 |
| >SNP8NRG124439__allelePos=201 total len = 401 SNP=Y chr8 | SEQ ID NO:312 |
| >SNP8NRG124558__allelePos=201 total len = 401 SNP=W chr8 | SEQ ID NO:313 |
| >SNP8NRG124752__allelePos=201 total len = 401 SNP=Y chr8 | SEQ ID NO:314 |
| >SNP8NRG125677__allelePos=201 total len = 401 SNP=Y chr8 | SEQ ID NO:315 |
| >SNP8NRG126412__allelePos=201 total len = 401 SNP=R chr8 | SEQ ID NO:316 |
| >SNP8NRG130571__allelePos=201 total len = 401 SNP=R chr8 | SEQ ID NO:317 |
| >SNP8NRG130654__allelePos=201 total len = 401 SNP=Y chr8 | SEQ ID NO:318 |
| >SNP8NRG132490__allelePos=201 total len = 401 SNP=W chr8 | SEQ ID NO:319 |
| >SNP8NRG132499__allelePos=201 total len = 401 SNP=S chr8 | SEQ ID NO:320 |
| >SNP8NRG133473__allelePos=201 total len = 401 SNP=R chr8 | SEQ ID NO:321 |
| >SNP8NRG133691__allelePos=201 total len = 401 SNP=Y chr8 | SEQ ID NO:322 |
| >SNP8NRG133884__allelePos=201 total len = 401 SNP=W chr8 | SEQ ID NO:323 |
| >SNP8NRG134648__allelePos=201 total len = 401 SNP=R chr8 | SEQ ID NO:324 |
| >SNP8NRG135038__allelePos=201 total len = 401 SNP=K chr8 | SEQ ID NO:325 |
| >SNP8NRG135255__allelePos=201 total len = 401 SNP=Y chr8 | SEQ ID NO:326 |
| >SNP8NRG135413__allelePos=201 total len = 401 SNP=Y chr8 | SEQ ID NO:327 |
| >SNP8NRG135774__allelePos=201 total len = 401 SNP=W chr8 | SEQ ID NO:328 |
| >SNP8NRG135802__allelePos=201 total len = 401 SNP=Y chr8 | SEQ ID NO:329 |
| >SNP8NRG136202__allelePos=201 total len = 401 SNP=R chr8 | SEQ ID NO:330 |
| >SNP8NRG137376__allelePos=201 total len = 401 SNP=M chr8 | SEQ ID NO:331 |
| >SNP8NRG137576__allelePos=201 total len = 401 SNP=R chr8 | SEQ ID NO:332 |
| >SNP8NRG137699__allelePos=201 total len = 401 SNP=Y chr8 | SEQ ID NO:333 |

TABLE 2-continued

Microsatellites, SNP's, and insertions/deletions in the 1.5 Mb sequence.

| | |
|---|---|
| >SNP8NRG138626__allelePos=201 total len = 401 SNP=R chr8 | SEQ ID NO:334 |
| >SNP8NRG139056__allelePos=201 total len = 401 SNP=Y chr8 | SEQ ID NO:335 |
| >SNP8NRG139274__allelePos=201 total len = 401 SNP=R chr8 | SEQ ID NO:336 |
| >SNP8NRG139281__allelePos=201 total len = 401 SNP=Y chr8 | SEQ ID NO:337 |
| >SNP8NRG140116__allelePos=201 total len = 401 SNP=M chr8 | SEQ ID NO:338 |
| >SNP8NRG140571__allelePos=201 total len = 401 SNP=R chr8 | SEQ ID NO:339 |
| >SNP8NRG140710__allelePos=201 total len = 401 SNP=S chr8 | SEQ ID NO:340 |
| >SNP8NRG140746__allelePos=201 total len = 401 SNP=R chr8 | SEQ ID NO:341 |
| >SNP8NRG141610__allelePos=201 total len = 401 SNP=R chr8 | SEQ ID NO:342 |
| >SNP8NRG141794__allelePos=201 total len = 401 SNP=Y chr8 | SEQ ID NO:343 |
| >SNP8NRG142053__allelePos=201 total len = 401 SNP=R chr8 | SEQ ID NO:344 |
| >SNP8NRG142994__allelePos=201 total len = 401 SNP=R chr8 | SEQ ID NO:345 |
| >SNP8NRG145525__allelePos=201 total len = 401 SNP=Y chr8 | SEQ ID NO:346 |
| >SNP8NRG147116__allelePos=201 total len = 401 SNP=R chr8 | SEQ ID NO:347 |
| >SNP8NRG147238__allelePos=201 total len = 401 SNP=Y chr8 | SEQ ID NO:348 |
| >SNP8NRG147778__allelePos=201 total len = 401 SNP=Y chr8 | SEQ ID NO:349 |
| >SNP8NRG148986__allelePos=201 total len = 401 SNP=W chr8 | SEQ ID NO:350 |
| >SNP8NRG149066__allelePos=201 total len = 401 SNP=R chr8 | SEQ ID NO:351 |
| >SNP8NRG150876__allelePos=201 total len = 401 SNP=K chr8 | SEQ ID NO:352 |
| >SNP8NRG151576__allelePos=201 total len = 401 SNP=R chr8 | SEQ ID NO:353 |
| >SNP8NRG153102__allelePos=201 total len = 401 SNP=Y chr8 | SEQ ID NO:354 |
| >SNP8NRG153109__allelePos=201 total len = 401 SNP=R chr8 | SEQ ID NO:355 |
| >SNP8NRG153982__allelePos=201 total len = 401 SNP=R chr8 | SEQ ID NO:356 |
| >SNP8NRG155677__allelePos=201 total len = 401 SNP=R chr8 | SEQ ID NO:357 |
| >SNP8NRG162185__allelePos=201 total len = 401 SNP=R chr8 | SEQ ID NO:358 |
| >SNP8NRG163442__allelePos=201 total len = 401 SNP=R chr8 | SEQ ID NO:359 |
| >SNP8NRG164247__allelePos=201 total len = 401 SNP=R chr8 | SEQ ID NO:360 |
| >SNP8NRG168136__allelePos=201 total len = 401 SNP=R chr8 | SEQ ID NO:361 |
| >SNP8NRG171197__allelePos=201 total len = 401 SNP=W chr8 | SEQ ID NO:362 |
| >SNP8NRG173048__allelePos=201 total len = 401 SNP=Y chr8 | SEQ ID NO:363 |
| >SNP8NRG174233__allelePos=201 total len = 401 SNP=Y chr8 | SEQ ID NO:364 |
| >SNP8NRG175189__allelePos=201 total len = 401 SNP=Y chr8 | SEQ ID NO:365 |
| >SNP8NRG177393__allelePos=201 total len = 401 SNP=K chr8 | SEQ ID NO:366 |
| >SNP8NRG178779__allelePos=201 total len = 401 SNP=R chr8 | SEQ ID NO:367 |
| >SNP8NRG190498__allelePos=201 total len = 401 SNP=R chr8 | SEQ ID NO:368 |
| >SNP8NRG190825__allelePos=201 total len = 401 SNP=K chr8 | SEQ ID NO:369 |
| >SNP8NRG191481__allelePos=201 total len = 401 SNP=R chr8 | SEQ ID NO:370 |
| >SNP8NRG194616__allelePos=201 total len = 401 SNP=Y chr8 | SEQ ID NO:371 |
| >SNP8NRG196375__allelePos=201 total len = 401 SNP=R chr8 | SEQ ID NO:372 |
| >SNP8NRG201429__allelePos=201 total len = 401 SNP=R chr8 | SEQ ID NO:373 |
| >SNP8NRG201857__allelePos=201 total len = 401 SNP=R chr8 | SEQ ID NO:374 |
| >SNP8NRG227098__allelePos=201 total len = 401 SNP=Y chr8 | SEQ ID NO:375 |
| >SNP8NRG227099__allelePos=201 total len = 401 SNP=Y chr8 | SEQ ID NO:376 |
| >SNP8NRG227168__allelePos=201 total len = 401 SNP=M chr8 | SEQ ID NO:377 |
| >SNP8NRG232116__allelePos=201 total len = 401 SNP=R chr8 | SEQ ID NO:378 |
| >SNP8NRG232811__allelePos=201 total len = 401 SNP=M chr8 | SEQ ID NO:379 |
| >SNP8NRG233398__allelePos=201 total len = 401 SNP=R chr8 | SEQ ID NO:380 |
| >SNP8NRG233965__allelePos=201 total len = 401 SNP=R chr8 | SEQ ID NO:381 |
| >SNP8NRG234179__allelePos=201 total len = 401 SNP=K chr8 | SEQ ID NO:382 |
| >SNP8NRG234841__allelePos=201 total len = 401 SNP=Y chr8 | SEQ ID NO:383 |
| >SNP8NRG235627__allelePos=201 total len = 401 SNP=M chr8 | SEQ ID NO:384 |
| >SNP8NRG236029__allelePos=201 total len = 401 SNP=R chr8 | SEQ ID NO:385 |
| >SNP8NRG236046__allelePos=201 total len = 401 SNP=Y chr8 | SEQ ID NO:386 |
| >SNP8NRG236171__allelePos=201 total len = 401 SNP=W chr8 | SEQ ID NO:387 |
| >SNP8NRG236551__allelePos=201 total len = 401 SNP=R chr8 | SEQ ID NO:388 |
| >SNP8NRG236576__allelePos=201 total len = 401 SNP=S chr8 | SEQ ID NO:389 |
| >SNP8NRG236991__allelePos=201 total len = 401 SNP=M chr8 | SEQ ID NO:390 |
| >SNP8NRG236992__allelePos=201 total len = 401 SNP=R chr8 | SEQ ID NO:391 |
| >SNP8NRG237502__allelePos=201 total len = 401 SNP=R chr8 | SEQ ID NO:392 |
| >SNP8NRG237871__allelePos=201 total len = 401 SNP=R chr8 | SEQ ID NO:393 |
| >SNP8NRG238018__allelePos=201 total len = 401 SNP=S chr8 | SEQ ID NO:394 |
| >SNP8NRG239573__allelePos=201 total len = 401 SNP=R chr8 | SEQ ID NO:395 |
| >SNP8NRG239710__allelePos=201 total len = 401 SNP=R chr8 | SEQ ID NO:396 |
| >SNP8NRG239788__allelePos=201 total len = 401 SNP=Y chr8 | SEQ ID NO:397 |
| >SNP8NRG249425__allelePos=201 total len = 401 SNP=R chr8 | SEQ ID NO:398 |
| >SNP8NRG369825__allelePos=201 total len = 401 SNP=S chr8 | SEQ ID NO:399 |
| >SNP8NRG370296__allelePos=201 total len = 401 SNP=R chr8 | SEQ ID NO:400 |
| >SNP8NRG370383__allelePos=201 total len = 401 SNP=S chr8 | SEQ ID NO:401 |
| >SNP8NRG370907__allelePos=201 total len = 401 SNP=W chr8 | SEQ ID NO:402 |
| >SNP8NRG370990__allelePos=201 total len = 401 SNP=W chr8 | SEQ ID NO:403 |
| >SNP8NRG377699__allelePos=201 total len = 401 SNP=Y chr8 | SEQ ID NO:404 |
| >SNP8NRG381914__allelePos=201 total len = 401 SNP=Y chr8 | SEQ ID NO:405 |
| >SNP8NRG383904__allelePos=201 total len = 401 SNP=W chr8 | SEQ ID NO:406 |
| >SNP8NRG383932__allelePos=201 total len = 401 SNP=Y chr8 | SEQ ID NO:407 |
| >SNP8NRG387409__allelePos=201 total len = 401 SNP=Y chr8 | SEQ ID NO:408 |
| >SNP8NRG389545__allelePos=201 total len = 401 SNP=R chr8 | SEQ ID NO:409 |
| >SNP8NRG392586__allelePos=201 total len = 401 SNP=Y chr8 | SEQ ID NO:410 |

TABLE 2-continued

Microsatellites, SNP's, and insertions/deletions in the 1.5 Mb sequence.

| | |
|---|---|
| >SNP8NRG394624_allelePos=201 total len = 401 SNP=K chr8 | SEQ ID NO:411 |
| >SNP8NRG395330_allelePos=201 total len = 401 SNP=Y chr8 | SEQ ID NO:412 |
| >SNP8NRG396628_allelePos=201 total len = 401 SNP=R chr8 | SEQ ID NO:413 |
| >SNP8NRG398073_allelePos=201 total len = 401 SNP=K chr8 | SEQ ID NO:414 |
| >SNP8NRG398648_allelePos=201 total len = 401 SNP=Y chr8 | SEQ ID NO:415 |
| >SNP8NRG400263_allelePos=201 total len = 401 SNP=S chr8 | SEQ ID NO:416 |
| >SNP8NRG400525_allelePos=201 total len = 401 SNP=K chr8 | SEQ ID NO:417 |
| >SNP8NRG400588_allelePos=201 total len = 401 SNP=R chr8 | SEQ ID NO:418 |
| >SNP8NRG402368_allelePos=201 total len = 401 SNP=R chr8 | SEQ ID NO:419 |
| >SNP8NRG404267_allelePos=201 total len = 401 SNP=Y chr8 | SEQ ID NO:420 |
| >SNP8NRG406091_allelePos=201 total len = 401 SNP=Y chr8 | SEQ ID NO:421 |
| >SNP8NRG411328_allelePos=201 total len = 401 SNP=R chr8 | SEQ ID NO:422 |
| >SNP8NRG412001_allelePos=201 total len = 401 SNP=W chr8 | SEQ ID NO:423 |
| >SNP8NRG412018_allelePos=201 total len = 401 SNP=Y chr8 | SEQ ID NO:424 |
| >SNP8NRG412043_allelePos=201 total len = 401 SNP=Y chr8 | SEQ ID NO:425 |
| >SNP8NRG412100_allelePos=201 total len = 401 SNP=Y chr8 | SEQ ID NO:426 |
| >SNP8NRG422881_allelePos=201 total len = 401 SNP=S chr8 | SEQ ID NO:427 |
| >SNP8NRG423035_allelePos=201 total len = 401 SNP=R chr8 | SEQ ID NO:428 |
| >SNP8NRG423355_allelePos=201 total len = 401 SNP=W chr8 | SEQ ID NO:429 |
| >SNP8NRG429703_allelePos=201 total len = 401 SNP=R chr8 | SEQ ID NO:430 |
| >SNP8NRG429867_allelePos=201 total len = 401 SNP=Y chr8 | SEQ ID NO:431 |
| >SNP8NRG434863_allelePos=201 total len = 401 SNP=M chr8 | SEQ ID NO:432 |
| >SNP8NRG434890_allelePos=201 total len = 401 SNP=K chr8 | SEQ ID NO:433 |
| >SNP8NRG434892_allelePos=201 total len = 401 SNP=S chr8 | SEQ ID NO:434 |
| >SNP8NRG434932_allelePos=201 total len = 401 SNP=M chr8 | SEQ ID NO:435 |
| >SNP8NRG437545_allelePos=201 total len = 401 SNP=R chr8 | SEQ ID NO:436 |
| >SNP8NRG439629_allelePos=201 total len = 401 SNP=R chr8 | SEQ ID NO:437 |
| >SNP8NRG442385_allelePos=201 total len = 401 SNP=R chr8 | SEQ ID NO:438 |
| >SNP8NRG442880_allelePos=201 total len = 401 SNP=R chr8 | SEQ ID NO:439 |
| >SNP8NRG449098_allelePos=201 total len = 401 SNP=S chr8 | SEQ ID NO:440 |
| >SNP8NRG451340_allelePos=201 total len = 401 SNP=M chr8 | SEQ ID NO:441 |
| >SNP8NRG454116_allelePos=201 total len = 401 SNP=K chr8 | SEQ ID NO:442 |
| >SNP8NRG461546_allelePos=201 total len = 401 SNP=M chr8 | SEQ ID NO:443 |
| >SNP8NRG462292_allelePos=201 total len = 401 SNP=K chr8 | SEQ ID NO:444 |
| >SNP8NRG464956_allelePos=201 total len = 401 SNP=R chr8 | SEQ ID NO:445 |
| >SNP8NRG472069_allelePos=201 total len = 401 SNP=Y chr8 | SEQ ID NO:446 |
| >SNP8NRG473050_allelePos=201 total len = 401 SNP=W chr8 | SEQ ID NO:447 |
| >SNP8NRG473051_allelePos=201 total len = 401 SNP=M chr8 | SEQ ID NO:448 |
| >SNP8NRG476333_allelePos=201 total len = 401 SNP=Y chr8 | SEQ ID NO:449 |
| >SNP8NRG483011_allelePos=201 total len = 401 SNP=R chr8 | SEQ ID NO:450 |
| >SNP8NRG484046_allelePos=201 total len = 401 SNP=Y chr8 | SEQ ID NO:451 |
| >SNP8NRG484650_allelePos=201 total len = 401 SNP=S chr8 | SEQ ID NO:452 |
| >SNP8NRG485315_allelePos=201 total len = 401 SNP=M chr8 | SEQ ID NO:453 |
| >SNP8NRG485472_allelePos=201 total len = 401 SNP=R chr8 | SEQ ID NO:454 |
| >SNP8NRG488313_allelePos=201 total len = 401 SNP=Y chr8 | SEQ ID NO:455 |
| >SNP8NRG488627_allelePos=201 total len = 401 SNP=Y chr8 | SEQ ID NO:456 |
| >SNP8NRG490854_allelePos=201 total len = 401 SNP=R chr8 | SEQ ID NO:457 |
| >SNP8NRG494555_allelePos=201 total len = 401 SNP=K chr8 | SEQ ID NO:458 |
| >SNP8NRG494672_allelePos=201 total len = 401 SNP=M chr8 | SEQ ID NO:459 |
| >SNP8NRG496172_allelePos=201 total len = 401 SNP=R chr8 | SEQ ID NO:460 |
| >SNP8NRG496507_allelePos=201 total len = 401 SNP=R chr8 | SEQ ID NO:461 |
| >SNP8NRG496884_allelePos=201 total len = 401 SNP=M chr8 | SEQ ID NO:462 |
| >SNP8NRG497394_allelePos=201 total len = 401 SNP=S chr8 | SEQ ID NO:463 |
| >SNP8NRG497582_allelePos=201 total len = 401 SNP=K chr8 | SEQ ID NO:464 |
| >SNP8NRG498525_allelePos=201 total len = 401 SNP=S chr8 | SEQ ID NO:465 |
| >SNP8NRG498545_allelePos=201 total len = 401 SNP=R chr8 | SEQ ID NO:466 |
| >SNP8NRG499091_allelePos=201 total len = 401 SNP=W chr8 | SEQ ID NO:467 |
| >SNP8NRG499290_allelePos=201 total len = 401 SNP=R chr8 | SEQ ID NO:468 |
| >SNP8NRG499298_allelePos=201 total len = 401 SNP=K chr8 | SEQ ID NO:469 |
| >SNP8NRG499581_allelePos=201 total len = 401 SNP=Y chr8 | SEQ ID NO:470 |
| >SNP8NRG500578_allelePos=201 total len = 401 SNP=Y chr8 | SEQ ID NO:471 |
| >SNP8NRG500943_allelePos=201 total len = 401 SNP=W chr8 | SEQ ID NO:472 |
| >SNP8NRG503311_allelePos=201 total len = 401 SNP=R chr8 | SEQ ID NO:473 |
| >SNP8NRG504384_allelePos=201 total len = 401 SNP=K chr8 | SEQ ID NO:474 |
| >SNP8NRG504990_allelePos=201 total len = 401 SNP=M chr8 | SEQ ID NO:475 |
| >SNP8NRG506059_allelePos=201 total len = 401 SNP=R chr8 | SEQ ID NO:476 |
| >SNP8NRG507061_allelePos=201 total len = 401 SNP=M chr8 | SEQ ID NO:477 |
| >SNP8NRG509968_allelePos=201 total len = 401 SNP=W chr8 | SEQ ID NO:478 |
| >SNP8NRG512008_allelePos=201 total len = 401 SNP=R chr8 | SEQ ID NO:479 |
| >SNP8NRG512165_allelePos=201 total len = 401 SNP=R chr8 | SEQ ID NO:480 |
| >SNP8NRG512759_allelePos=201 total len = 401 SNP=R chr8 | SEQ ID NO:481 |
| >SNP8NRG514033_allelePos=201 total len = 401 SNP=Y chr8 | SEQ ID NO:482 |
| >SNP8NRG514826_allelePos=201 total len = 401 SNP=Y chr8 | SEQ ID NO:483 |
| >SNP8NRG514880_allelePos=201 total len = 401 SNP=Y chr8 | SEQ ID NO:484 |
| >SNP8NRG515070_allelePos=201 total len = 401 SNP=R chr8 | SEQ ID NO:485 |
| >SNP8NRG517359_allelePos=201 total len = 401 SNP=R chr8 | SEQ ID NO:486 |
| >SNP8NRG517502_allelePos=201 total len = 401 SNP=W chr8 | SEQ ID NO:487 |

TABLE 2-continued

Microsatellites, SNP's, and insertions/deletions in the 1.5 Mb sequence.

| | |
|---|---|
| >SNP8NRG517828__allelePos=201 total len = 401 SNP=Y chr8 | SEQ ID NO:488 |
| >SNP8NRG518694__allelePos=201 total len = 401 SNP=Y chr8 | SEQ ID NO:489 |
| >SNP8NRG518760__allelePos=201 total len = 401 SNP=W chr8 | SEQ ID NO:490 |
| >SNP8NRG530128__allelePos=201 total len = 401 SNP=M chr8 | SEQ ID NO:491 |
| >SNP8NRG534135__allelePos=201 total len = 401 SNP=K chr8 | SEQ ID NO:492 |
| >SNP8NRG534842__allelePos=201 total len = 401 SNP=S chr8 | SEQ ID NO:493 |
| >SNP8NRG536457__allelePos=201 total len = 401 SNP=Y chr8 | SEQ ID NO:494 |
| >SNP8NRG536464__allelePos=201 total len = 401 SNP=R chr8 | SEQ ID NO:495 |
| >SNP8NRG536524__allelePos=201 total len = 401 SNP=Y chr8 | SEQ ID NO:496 |
| >SNP8NRG536710__allelePos=201 total len = 401 SNP=R chr8 | SEQ ID NO:497 |
| >SNP8NRG536715__allelePos=201 total len = 401 SNP=R chr8 | SEQ ID NO:498 |
| >SNP8NRG536847__allelePos=201 total len = 401 SNP=R chr8 | SEQ ID NO:499 |
| >SNP8NRG536874__allelePos=201 total len = 401 SNP=R chr8 | SEQ ID NO:500 |
| >SNP8NRG537100__allelePos=201 total len = 401 SNP=R chr8 | SEQ ID NO:501 |
| >SNP8NRG537158__allelePos=201 total len = 401 SNP=R chr8 | SEQ ID NO:502 |
| >SNP8NRG537813__allelePos=201 total len = 401 SNP=Y chr8 | SEQ ID NO:503 |
| >SNP8NRG537869__allelePos=201 total len = 401 SNP=R chr8 | SEQ ID NO:504 |
| >SNP8NRG538785__allelePos=201 total len = 401 SNP=K chr8 | SEQ ID NO:505 |
| >SNP8NRG538824__allelePos=201 total len = 401 SNP=W chr8 | SEQ ID NO:506 |
| >SNP8NRG538855__allelePos=201 total len = 401 SNP=Y chr8 | SEQ ID NO:507 |
| >SNP8NRG539044__allelePos=201 total len = 401 SNP=Y chr8 | SEQ ID NO:508 |
| >SNP8NRG539419__allelePos=201 total len = 401 SNP=R chr8 | SEQ ID NO:509 |
| >SNP8NRG539996__allelePos=201 total len = 401 SNP=R chr8 | SEQ ID NO:510 |
| >SNP8NRG540481__allelePos=201 total len = 401 SNP=Y chr8 | SEQ ID NO:511 |
| >SNP8NRG540881__allelePos=201 total len = 401 SNP=R chr8 | SEQ ID NO:512 |
| >SNP8NRG542076__allelePos=201 total len = 401 SNP=R chr8 | SEQ ID NO:513 |
| >SNP8NRG542308__allelePos=201 total len = 401 SNP=Y chr8 | SEQ ID NO:514 |
| >SNP8NRG543443__allelePos=201 total len = 401 SNP=R chr8 | SEQ ID NO:515 |
| >SNP8NRG543893__allelePos=201 total len = 401 SNP=Y chr8 | SEQ ID NO:516 |
| >SNP8NRG544125__allelePos=201 total len = 401 SNP=R chr8 | SEQ ID NO:517 |
| >SNP8NRG545032__allelePos=201 total len = 401 SNP=M chr8 | SEQ ID NO:518 |
| >SNP8NRG546398__allelePos=201 total len = 401 SNP=R chr8 | SEQ ID NO:519 |
| >SNP8NRG546759__allelePos=201 total len = 401 SNP=R chr8 | SEQ ID NO:520 |
| >SNP8NRG547077__allelePos=201 total len = 401 SNP=S chr8 | SEQ ID NO:521 |
| >SNP8NRG547488__allelePos=201 total len = 401 SNP=Y chr8 | SEQ ID NO:522 |
| >SNP8NRG549025__allelePos=201 total len = 401 SNP=K chr8 | SEQ ID NO:523 |
| >SNP8NRG549845__allelePos=201 total len = 401 SNP=R chr8 | SEQ ID NO:524 |
| >SNP8NRG5508S4__allelePos=201 total len = 401 SNP=R chr8 | SEQ ID NO:525 |
| >SNP8NRG551624__allelePos=201 total len = 401 SNP=R chr8 | SEQ ID NO:526 |
| >SNP8NRG552970__allelePos=201 total len = 401 SNP=W chr8 | SEQ ID NO:527 |
| >SNP8NRG552995__allelePos=201 total len = 401 SNP=R chr8 | SEQ ID NO:528 |
| >SNP8NRG555662__allelePos=201 total len = 401 SNP=Y chr8 | SEQ ID NO:529 |
| >SNP8NRG556028__allelePos=201 total len = 401 SNP=R chr8 | SEQ ID NO:530 |
| >SNP8NRG556277__allelePos=201 total len = 401 SNP=R chr8 | SEQ ID NO:531 |
| >SNP8NRG556576__allelePos=201 total len = 401 SNP=R chr8 | SEQ ID NO:532 |
| >SNP8NRG557028__allelePos=201 total len = 401 SNP=Y chr8 | SEQ ID NO:533 |
| >SNP8NRG566570__allelePos=201 total len = 401 SNP=M chr8 | SEQ ID NO:534 |
| >SNP8NRG569281__allelePos=201 total len = 401 SNP=Y chr8 | SEQ ID NO:535 |
| >SNP8NRGS70088__allelePos=201 total len = 401 SNP=Y chr8 | SEQ ID NO:536 |
| >SNP8NRGS707S4__allelePos=201 total len = 401 SNP=Y chr8 | SEQ ID NO:537 |
| >SNP8NRG570925__allelePos=201 total len = 401 SNP=R chr8 | SEQ ID NO:538 |
| >SNP8NRG572718__allelePos=201 total len = 401 SNP=Y chr8 | SEQ ID NO:539 |
| >SNP8NRG573656__allelePos=201 total len = 401 SNP=R chr8 | SEQ ID NO:540 |
| >SNP8NRGS77185__allelePos=201 total len = 401 SNP=W chr8 | SEQ ID NO:541 |
| >SNP8NRG579492__allelePos=201 total len = 401 SNP=Y chr8 | SEQ ID NO:542 |
| >SNP8NRG582975__allelePos=201 total len = 401 SNP=Y chr8 | SEQ ID NO:543 |
| >SNP8NRG589273__allelePos=201 total len = 401 SNP=W chr8 | SEQ ID NO:544 |
| >SNP8NRGS90073__allelePos=201 total len = 401 SNP=K chr8 | SEQ ID NO:545 |
| >SNP8NRG593971__allelePos=201 total len = 401 SNP=R chr8 | SEQ ID NO:546 |
| >SNP8NRG594222__allelePos=201 total len = 401 SNP=M chr8 | SEQ ID NO:547 |
| >SNP8NRG594969__allelePos=201 total len = 401 SNP=Y chr8 | SEQ ID NO:548 |
| >SNP8NRG598261__allelePos=201 total len = 401 SNP=M chr8 | SEQ ID NO:549 |
| >SNP8NRG600941__allelePos=201 total len = 401 SNP=Y chr8 | SEQ ID NO:550 |
| >SNP8NRG601424__allelePos=201 total len = 401 SNP=Y chr8 | SEQ ID NO:551 |
| >SNP8NRG602056__allelePos=201 total len = 401 SNP=W chr8 | SEQ ID NO:552 |
| >SNP8NRG603048__allelePos=201 total len = 401 SNP=Y chr8 | SEQ ID NO:553 |
| >SNP8NRG605839__allelePos=201 total len = 401 SNP=Y chr8 | SEQ ID NO:554 |
| >SNP8NRG608117__allelePos=201 total len = 401 SNP=Y chr8 | SEQ ID NO:555 |
| >SNP8NRG616296__allelePos=201 total len = 401 SNP=W chr8 | SEQ ID NO:556 |
| >SNP8NRG620232__allelePos=201 total len = 401 SNP=Y chr8 | SEQ ID NO:557 |
| >SNP8NRG620810__allelePos=201 total len = 401 SNP=K chr8 | SEQ ID NO:558 |
| >SNP8NRG655013__allelePos=201 total len = 401 SNP=Y chr8 | SEQ ID NO:559 |
| >SNP8NRG677216__allelePos=201 total len = 401 SNP=W chr8 | SEQ ID NO:560 |
| >SNP8NRG677458__allelePos=201 total len = 401 SNP=R chr8 | SEQ ID NO:561 |
| >SNP8NRG677746__allelePos=201 total len = 401 SNP=R chr8 | SEQ ID NO:562 |
| >SNP8NRG678032__allelePos=201 total len = 401 SNP=R chr8 | SEQ ID NO:563 |
| >SNP8NRG678127__allelePos=201 total len = 401 SNP=Y chr8 | SEQ ID NO:564 |

TABLE 2-continued

Microsatellites, SNP's, and insertions/deletions in the 1.5 Mb sequence.

| | |
|---|---|
| >SNP8NRG678862__allelePos=201 total len = 401 SNP=Y chr8 | SEQ ID NO:565 |
| >SNP8NRG678954__allelePos=201 total len = 401 SNP=R chr8 | SEQ ID NO:566 |
| >SNP8NRG679070__allelePos=201 total len = 401 SNP=S chr8 | SEQ ID NO:567 |
| >SNP8NRG679557__allelePos=201 total len = 401 SNP=R chr8 | SEQ ID NO:568 |
| >SNP8NRG679688__allelePos=201 total len = 401 SNP=Y chr8 | SEQ ID NO:569 |
| >SNP8NRG679842__allelePos=201 total len = 401 SNP=M chr8 | SEQ ID NO:570 |
| >SNP8NRG680471__allelePos=201 total len = 401 SNP=S chr8 | SEQ ID NO:571 |
| >SNP8NRG680652__allelePos=201 total len = 401 SNP=S chr8 | SEQ ID NO:572 |
| >SNP8NRG680660__allelePos=201 total len = 401 SNP=Y chr8 | SEQ ID NO:573 |
| >SNP8NRG681146__allelePos=201 total len = 401 SNP=Y chr8 | SEQ ID NO:574 |
| >SNP8NRG681199__allelePos=201 total len = 401 SNP=W chr8 | SEQ ID NO:575 |
| >SNP8NRG681415__allelePos=201 total len = 401 SNP=R chr8 | SEQ ID NO:576 |
| >SNP8NRG681417__allelePos=201 total len = 401 SNP=R chr8 | SEQ ID NO:577 |
| >SNP8NRG681505__allelePos=201 total len = 401 SNP=R chr8 | SEQ ID NO:578 |
| >SNP8NRG682121__allelePos=201 total len = 401 SNP=Y chr8 | SEQ ID NO:579 |
| >SNP8NRG682288__allelePos=201 total len = 401 SNP=M chr8 | SEQ ID NO:580 |
| >SNP8NRG682494__allelePos=201 total len = 401 SNP=K chr8 | SEQ ID NO:581 |
| >SNP8NRG682578__allelePos=201 total len = 401 SNP=R chr8 | SEQ ID NO:582 |
| >SNP8NRG682743__allelePos=201 total len = 401 SNP=Y chr8 | SEQ ID NO:583 |
| >SNP8NRG683348__allelePos=201 total len = 401 SNP=R chr8 | SEQ ID NO:584 |
| >SNP8NRG683504__allelePos=201 total len = 401 SNP=R chr8 | SEQ ID NO:585 |
| >SNP8NRG683993__allelePos=201 total len = 401 SNP=K chr8 | SEQ ID NO:586 |
| >SNP8NRG684423__allelePos=201 total len = 401 SNP=R chr8 | SEQ ID NO:587 |
| >SNP8NRG684806__allelePos=201 total len = 401 SNP=Y chr8 | SEQ ID NO:588 |
| >SNP8NRG684942__allelePos=201 total len = 401 SNP=R chr8 | SEQ ID NO:589 |
| >SNP8NRG684966__allelePos=201 total len = 401 SNP=R chr8 | SEQ ID NO:590 |
| >SNP8NRG685267__allelePos=201 total len = 401 SNP=R chr8 | SEQ ID NO:591 |
| >SNP8NRG685344__allelePos=201 total len = 401 SNP=R chr8 | SEQ ID NO:592 |
| >SNP8NRG685448__allelePos=201 total len = 401 SNP=R chr8 | SEQ ID NO:593 |
| >SNP8NRG685616__allelePos=201 total len = 401 SNP=R chr8 | SEQ ID NO:594 |
| >SNP8NRG686138__allelePos=201 total len = 401 SNP=Y chr8 | SEQ ID NO:595 |
| >SNP8NRG686236__allelePos=201 total len = 401 SNP=S chr8 | SEQ ID NO:596 |
| >SNP8NRG686480__allelePos=201 total len = 401 SNP=R chr8 | SEQ ID NO:597 |
| >SNP8NRG687371__allelePos=201 total len = 401 SNP=Y chr8 | SEQ ID NO:598 |
| >SNP8NRG688378__allelePos=201 total len = 401 SNP=K chr8 | SEQ ID NO:599 |
| >SNP8NRG689067__allelePos=201 total len = 401 SNP=M chr8 | SEQ ID NO:600 |
| >SNP8NRG689479__allelePos=201 total len = 401 SNP=M chr8 | SEQ ID NO:601 |
| >SNP8NRG691268__allelePos=201 total len = 401 SNP=K chr8 | SEQ ID NO:602 |
| >SNP8NRG691470__allelePos=201 total len = 401 SNP=Y chr8 | SEQ ID NO:603 |
| >SNP8NRG691967__allelePos=201 total len = 401 SNP=R chr8 | SEQ ID NO:604 |
| >SNP8NRG692205__allelePos=201 total len = 401 SNP=S chr8 | SEQ ID NO:605 |
| >SNP8NRG695197__allelePos=201 total len = 401 SNP=Y chr8 | SEQ ID NO:606 |
| >SNP8NRG695344__allelePos=201 total len = 401 SNP=Y chr8 | SEQ ID NO:607 |
| >SNP8NRG695721__allelePos=201 total len = 401 SNP=M chr8 | SEQ ID NO:608 |
| >SNP8NRG696882__allelePos=201 total len = 401 SNP=K chr8 | SEQ ID NO:609 |
| >SNP8NRG698221__allelePos=201 total len = 401 SNP=R chr8 | SEQ ID NO:610 |
| >SNP8NRG698840__allelePos=201 total len = 401 SNP=R chr8 | SEQ ID NO:611 |
| >SNP8NRG699486__allelePos=201 total len = 401 SNP=W chr8 | SEQ ID NO:612 |
| >SNP8NRG700187__allelePos=201 total len = 401 SNP=R chr8 | SEQ ID NO:613 |
| >SNP8NRG702591__allelePos=201 total len = 401 SNP=R chr8 | SEQ ID NO:614 |
| >SNP8NRG704565__allelePos=201 total len = 401 SNP=K chr8 | SEQ ID NO:615 |
| >SNP8NRG704566__allelePos=201 total len = 401 SNP=K chr8 | SEQ ID NO:616 |
| >SNP8NRG705986__allelePos=201 total len = 401 SNP=R chr8 | SEQ ID NO:617 |
| >SNP8NRG706716__a1lelePos=201 total len = 401 SNP=S chr8 | SEQ ID NO:618 |
| >SNP8NRG706760__allelePos=201 total len = 401 SNP=W chr8 | SEQ ID NO:619 |
| >SNP8NRG706787__allelePos=201 total len = 401 SNP=Y chr8 | SEQ ID NO:620 |
| >SNP8NRG707025__allelePos=201 total len = 401 SNP=Y chr8 | SEQ ID NO:621 |
| >SNP8NRG707181__allelePos=201 total len = 401 SNP=R chr8 | SEQ ID NO:622 |
| >SNP8NRG707385__allelePos=201 total len = 401 SNP=Y chr8 | SEQ ID NO:623 |
| >SNP8NRG707818__allelePos=201 total len = 401 SNP=M chr8 | SEQ ID NO:624 |
| >SNP8NRG708196__allelePos=201 total len = 401 SNP=Y chr8 | SEQ ID NO:625 |
| >SNP8NRG709613__allelePos=201 total len = 401 SNP=Y chr8 | SEQ ID NO:626 |
| >SNP8NRG711016__allelePos=201 total len = 401 SNP=M chr8 | SEQ ID NO:627 |
| >SNP8NRG711547__allelePos=201 total len = 401 SNP=Y chr8 | SEQ ID NO:628 |
| >SNP8NRG711631__allelePos=201 total len = 401 SNP=R chr8 | SEQ ID NO:629 |
| >SNP8NRG711906__allelePos=201 total len = 401 SNP=Y chr8 | SEQ ID NO:630 |
| >SNP8NRG712006__allelePos=201 total len = 401 SNP=Y chr8 | SEQ ID NO:631 |
| >SNP8NRG712008__allelePos=201 total len = 401 SNP=Y chr8 | SEQ ID NO:632 |
| >SNP8NRG712019__allelePos=201 total len = 401 SNP=M chr8 | SEQ ID NO:633 |
| >SNP8NRG712021__allelePos=201 total len = 401 SNP=M chr8 | SEQ ID NO:634 |
| >SNP8NRG712197__allelePos=201 total len = 401 SNP=R chr8 | SEQ ID NO:635 |
| >SNP8NRG713338__allelePos=201 total len = 401 SNP=R chr8 | SEQ ID NO:636 |
| >SNP8NRG714098__allelePos=201 total len = 401 SNP=K chr8 | SEQ ID NO:637 |
| >SNP8NRG721644__allelePos=201 total len = 401 SNP=R chr8 | SEQ ID NO:638 |
| >SNP8NRG722161__allelePos=201 total len = 401 SNP=M chr8 | SEQ ID NO:639 |
| >SNP8NRG732174__allelePos=201 total len = 401 SNP=S chr8 | SEQ ID NO:640 |
| >SNP8NRG732649__allelePos=201 total len = 401 SNP=S chr8 | SEQ ID NO:641 |

TABLE 2-continued

Microsatellites, SNP's, and insertions/deletions in the 1.5 Mb sequence.

| | |
|---|---|
| >SNP8NRG738227_allelePos=201 total len = 401 SNP=R chr8 | SEQ ID NO:642 |
| >SNP8NRG746622_allelePos=201 total len = 401 SNP=W chr8 | SEQ ID NO:643 |
| >SNP8NRG759168_allelePos=201 total len = 401 SNP=R chr8 | SEQ ID NO:644 |
| >SNP8NRG759175_allelePos=201 total len = 401 SNP=W chr8 | SEQ ID NO:645 |
| >SNP8NRG759193_allelePos=201 total len = 401 SNP=R chr8 | SEQ ID NO:646 |
| >SNP8NRG759194_allelePos=201 total len = 401 SNP=K chr8 | SEQ ID NO:647 |
| >SNP8NRG781458_allelePos=201 total len = 401 SNP=Y chr8 | SEQ ID NO:648 |
| >SNP8NRG781466_allelePos=201 total len = 401 SNP=S chr8 | SEQ ID NO:649 |
| >SNP8NRG781469_allelePos=201 total len = 401 SNP=M chr8 | SEQ ID NO:650 |
| >SNP8NRG781478_allelePos=201 total len = 401 SNP=M chr8 | SEQ ID NO:651 |
| >SNP8NRG781571_allelePos=201 total len = 401 SNP=M chr8 | SEQ ID NO:652 |
| >SNP8NRG783432_allelePos=201 total len = 401 SNP=R chr8 | SEQ ID NO:653 |
| >SNP8NRG801900_allelePos=201 total len = 401 SNP=Y chr8 | SEQ ID NO:654 |
| >SNP8NRG801945_allelePos=201 total len = 401 SNP=W chr8 | SEQ ID NO:655 |
| >SNP8NRG801972_allelePos=201 total len = 401 SNP=R chr8 | SEQ ID NO:656 |
| >SNP8NRG802948_allelePos=201 total len = 401 SNP=R chr8 | SEQ ID NO:657 |
| >SNP8NRG803902_allelePos=201 total len = 401 SNP=K chr8 | SEQ ID NO:658 |
| >SNP8NRG804933_allelePos=201 total len = 401 SNP=K chr8 | SEQ ID NO:659 |
| >SNP8NRG808369_allelePos=201 total len = 401 SNP=K chr8 | SEQ ID NO:660 |
| >SNP8NRG810103_allelePos=201 total len = 401 SNP=R chr8 | SEQ ID NO:661 |
| >SNP8NRG811374_allelePos=201 total len = 401 SNP=K chr8 | SEQ ID NO:662 |
| >SNP8NRG812451_allelePos=201 total len = 401 SNP=W chr8 | SEQ ID NO:663 |
| >SNP8NRG812814_allelePos=201 total len = 401 SNP=K chr8 | SEQ ID NO:664 |
| >SNP8NRG813632_allelePos=201 total len = 401 SNP=R chr8 | SEQ ID NO:665 |
| >SNP8NRG815395_allelePos=201 total len = 401 SNP=Y chr8 | SEQ ID NO:666 |
| >SNP8NRG815510_allelePos=201 total len = 401 SNP=R chr8 | SEQ ID NO:667 |
| >SNP8NRG815632_allelePos=201 total len = 401 SNP=Y chr8 | SEQ ID NO:668 |
| >SNP8NRG816259_allelePos=201 total len = 401 SNP=Y chr8 | SEQ ID NO:669 |
| >SNP8NRG817230_allelePos=201 total len = 401 SNP=R chr8 | SEQ ID NO:670 |
| >SNP8NRG817257_allelePos=201 total len = 401 SNP=Y chr8 | SEQ ID NO:671 |
| >SNP8NRG817495_allelePos=201 total len = 401 SNP=R chr8 | SEQ ID NO:672 |
| >SNP8NRG817897_allelePos=201 total len = 401 SNP=R chr8 | SEQ ID NO:673 |
| >SNP8NRG820736_allelePos=201 total len = 401 SNP=R chr8 | SEQ ID NO:674 |
| >SNP8NRG821031_allelePos=201 total len = 401 SNP=K chr8 | SEQ ID NO:675 |
| >SNP8NRG821032_allelePos=201 total len = 401 SNP=R chr8 | SEQ ID NO:676 |
| >SNP8NRG821185_allelePos=201 total len = 401 SNP=W chr8 | SEQ ID NO:677 |
| >SNP8NRG821566_allelePos=201 total len = 401 SNP=R chr8 | SEQ ID NO:678 |
| >SNP8NRG822470_allelePos=201 total len = 401 SNP=M chr8 | SEQ ID NO:679 |
| >SNP8NRG823186_allelePos=201 total len = 401 SNP=Y chr8 | SEQ ID NO:680 |
| >SNP8NRG823501_allelePos=201 total len = 401 SNP=Y chr8 | SEQ ID NO:681 |
| >SNP8NRG823799_allelePos=201 total len = 401 SNP=R chr8 | SEQ ID NO:682 |
| >SNP8NRG823932_allelePos=201 total len = 401 SNP=R chr8 | SEQ ID NO:683 |
| >SNP8NRG824172_allelePos=201 total len = 401 SNP=Y chr8 | SEQ ID NO:684 |
| >SNP8NRG824591_allelePos=201 total len = 401 SNP=R chr8 | SEQ ID NO:685 |
| >SNP8NRG826307_allelePos=201 total len = 401 SNP=K chr8 | SEQ ID NO:686 |
| >SNP8NRG826553_allelePos=201 total len = 401 SNP=Y chr8 | SEQ ID NO:687 |
| >SNP8NRG827004_allelePos=201 total len = 401 SNP=Y chr8 | SEQ ID NO:688 |
| >SNP8NRG827707_allelePos=201 total len = 401 SNP=K chr8 | SEQ ID NO:689 |
| >SNP8NRG830857_allelePos=201 total len = 401 SNP=W chr8 | SEQ ID NO:690 |
| >SNP8NRG831517_allelePos=201 total len = 401 SNP=Y chr8 | SEQ ID NO:691 |
| >SNP8NRG831598_allelePos=201 total len = 401 SNP=Y chr8 | SEQ ID NO:692 |
| >SNP8NRG831694_allelePos=201 total len = 401 SNP=Y chr8 | SEQ ID NO:693 |
| >SNP8NRG832144_allelePos=201 total len = 401 SNP=K chr8 | SEQ ID NO:694 |
| >SNP8NRG832522_allelePos=201 total len = 401 SNP=R chr8 | SEQ ID NO:695 |
| >SNP8NRG832544_allelePos=201 total len = 401 SNP=Y chr8 | SEQ ID NO:696 |
| >SNP8NRG832623_allelePos=201 total len = 401 SNP=Y chr8 | SEQ ID NO:697 |
| >SNP8NRG832958_allelePos=201 total len = 401 SNP=Y chr8 | SEQ ID NO:698 |
| >SNP8NRG833050_allelePos=201 total len = 401 SNP=W chr8 | SEQ ID NO:699 |
| >SNP8NRG833249_allelePos=201 total len = 401 SNP=K chr8 | SEQ ID NO:700 |
| >SNP8NRG833254_allelePos=201 total len = 401 SNP=Y chr8 | SEQ ID NO:701 |
| >SNP8NRG835058_allelePos=201 total len = 401 SNP=Y chr8 | SEQ ID NO:702 |
| >SNP8NRG835833_allelePos=201 total len = 401 SNP=R chr8 | SEQ ID NO:703 |
| >SNP8NRG836507_allelePos=201 total len = 401 SNP=R chr8 | SEQ ID NO:704 |
| >SNP8NRG837119_allelePos=201 total len = 401 SNP=Y chr8 | SEQ ID NO:705 |
| >SNP8NRG837766_allelePos=201 total len = 401 SNP=R chr8 | SEQ ID NO:706 |
| >SNP8NRG838113_allelePos=201 total len = 401 SNP=K chr8 | SEQ ID NO:707 |
| >SNP8NRG838835_allelePos=201 total len = 401 SNP=R chr8 | SEQ ID NO:708 |
| >SNP8NRG839935_allelePos=201 total len = 401 SNP=R chr8 | SEQ ID NO:709 |
| >SNP8NRG840940_allelePos=201 total len = 401 SNP=Y chr8 | SEQ ID NO:710 |
| >SNP8NRG841505_allelePos=201 total len = 401 SNP=Y chr8 | SEQ ID NO:711 |
| >SNP8NRG842075_allelePos=201 total len = 401 SNP=R chr8 | SEQ ID NO:712 |
| >SNP8NRG842631_allelePos=201 total len = 401 SNP=R chr8 | SEQ ID NO:713 |
| >SNP8NRG843040_allelePos=201 total len = 401 SNP=R chr8 | SEQ ID NO:714 |
| >SNP8NRG844427_allelePos=201 total len = 401 SNP=K chr8 | SEQ ID NO:715 |
| >SNP8NRG844589_allelePos=201 total len = 401 SNP=M chr8 | SEQ ID NO:716 |
| >SNP8NRG844815_allelePos=201 total len = 401 SNP=M chr8 | SEQ ID NO:717 |
| >SNP8NRG845435_allelePos=201 total len = 401 SNP=R chr8 | SEQ ID NO:718 |

TABLE 2-continued

Microsatellites, SNP's, and insertions/deletions in the 1.5 Mb sequence.

| | |
|---|---|
| >SNP8NRG845506__allelePos=201 total len = 401 SNP=M chr8 | SEQ ID NO:719 |
| >SNP8NRG845751__allelePos=201 total len = 401 SNP=K chr8 | SEQ ID NO:720 |
| >SNP8NRG845818__allelePos=201 total len = 401 SNP=W chr8 | SEQ ID NO:721 |
| >SNP8NRG845981__allelePos=201 total len = 401 SNP=R chr8 | SEQ ID NO:722 |
| >SNP8NRG846192__allelePos=201 total len = 401 SNP=R chr8 | SEQ ID NO:723 |
| >SNP8NRG846323__allelePos=201 total len = 401 SNP=W chr8 | SEQ ID NO:724 |
| >SNP8NRG846553__allelePos=201 total len = 401 SNP=Y chr8 | SEQ ID NO:725 |
| >SNP8NRG846846__allelePos=201 total len = 401 SNP=M chr8 | SEQ ID NO:726 |
| >SNP8NRG846876__allelePos=201 total len = 401 SNP=S chr8 | SEQ ID NO:727 |
| >SNP8NRG846929__allelePos=201 total len = 401 SNP=W chr8 | SEQ ID NO:728 |
| >SNP8NRG847327__allelePos=201 total len = 401 SNP=S chr8 | SEQ ID NO:729 |
| >SNP8NRG847992__allelePos=201 total len = 401 SNP=M chr8 | SEQ ID NO:730 |
| >SNP8NRG848193__allelePos=201 total len = 401 SNP=Y chr8 | SEQ ID NO:731 |
| >SNP8NRG848437__allelePos=201 total len = 401 SNP=S chr8 | SEQ ID NO:732 |
| >SNP8NRG848956__allelePos=201 total len = 401 SNP=R chr8 | SEQ ID NO:733 |
| >SNP8NRG849944__allelePos=201 total len = 401 SNP=R chr8 | SEQ ID NO:734 |
| >SNP8NRG850420__allelePos=201 total len = 401 SNP=R chr8 | SEQ ID NO:735 |
| >SNP8NRG850692__allelePos=201 total len = 401 SNP=K chr8 | SEQ ID NO:736 |
| >SNP8NR0850853__allelePos=201 total len = 401 SNP=R chr8 | SEQ ID NO:737 |
| >SNP8NRG850953__allelePos=201 total len = 401 SNP=R chr8 | SEQ ID NO:738 |
| >SNP8NRG850964__a1IelePos=201 total len = 401 SNP=R chr8 | SEQ ID NO:739 |
| >SNP8NRG851181__allelePos=201 total len = 401 SNP=R chr8 | SEQ ID NO:740 |
| >SNP8NRG851217__allelePos=201 total len = 401 SNP=K chr8 | SEQ ID NO:741 |
| >SNP8NRG851509__allelePos=201 total len = 401 SNP=R chr8 | SEQ ID NO:742 |
| >SNP8NRGS52107__allelePos=201 total len = 401 SNP=K chr8 | SEQ ID NO:743 |
| >SNP8NRG852368__allelePos=201 total len = 401 SNP=W chr8 | SEQ ID NO:744 |
| >SNP8NRG852785__allelePos=201 total len = 401 SNP=K chr8 | SEQ ID NO:745 |
| >SNP8NRG852855__allelePos=201 total len = 401 SNP=Y chr8 | SEQ ID NO:746 |
| >SNP8NRG853938__allelePos=201 total len = 401 SNP=K chr8 | SEQ ID NO:747 |
| >SNP8NRG854211__allelePos=201 total len = 401 SNP=R chr8 | SEQ ID NO:748 |
| >SNP8NRG854225__allelePos=201 total len = 401 SNP=R chr8 | SEQ ID NO:749 |
| >SNP8NRG854274__allelePos=201 total len = 401 SNP=W chr8 | SEQ ID NO:750 |
| >SNP8NRG854889__allelePos=201 total len = 401 SNP=R chr8 | SEQ ID NO:751 |
| >SNP8NRG855050__allelePos=201 total len = 401 SNP=R chr8 | SEQ ID NO:752 |
| >SNP8NRG855122__allelePos=201 total len = 401 SNP=Y chr8 | SEQ ID NO:753 |
| >SNP8NRG855659__allelePos=201 total len = 401 SNP=R chr8 | SEQ ID NO:754 |
| >SNP8NRG855946__allelePos=201 total len = 401 SNP=W chr8 | SEQ ID NO:755 |
| >SNP8NRG856254__allelePos=201 total len = 401 SNP=W chr8 | SEQ ID NO:756 |
| >SNP8NRG856374__allelePos=201 total len = 401 SNP=R chr8 | SEQ ID NO:757 |
| >SNP8NRG857434__allelePos=201 total len = 401 SNP=Y chr8 | SEQ ID NO:758 |
| >SNP8NRG857668__allelePos=201 total len = 401 SNP=M chr8 | SEQ ID NO:759 |
| >SNP8NRG857708__allelePos=201 total len = 401 SNP=R chr8 | SEQ ID NO:760 |
| >SNP8NRG858008__allelePos=201 total len = 401 SNP=W chr8 | SEQ ID NO:761 |
| >SNP8NRG858045__allelePos=201 total len = 401 SNP=K chr8 | SEQ ID NO:762 |
| >SNP8NRG858368__allelePos=201 total len = 401 SNP=R chr8 | SEQ ID NO:763 |
| >SNP8NRG858826__allelePos=201 total len = 401 SNP=R chr8 | SEQ ID NO:764 |
| >SNP8NRG858861__allelePos=201 total len = 401 SNP=S chr8 | SEQ ID NO:765 |
| >SNP8NRG859550__allelePos=201 total len = 401 SNP=Y chr8 | SEQ ID NO:766 |
| >SNP8NRG859612__allelePos=201 total len = 401 SNP=W chr8 | SEQ ID NO:767 |
| >SNP8NRG859720__allelePos=201 total len = 401 SNP=Y chr8 | SEQ ID NO:768 |
| >SNP8NRG859860__allelePos=201 total len = 401 SNP=Y chr8 | SEQ ID NO:769 |
| >SNP8NRG860269__allelePos=201 total len = 401 SNP=W chr8 | SEQ ID NO:770 |
| >SNP8NRG860299__allelePos=201 total len = 401 SNP=K chr8 | SEQ ID NO:771 |
| >SNP8NRG861172__allelePos=201 total len = 401 SNP=M chr8 | SEQ ID NO:772 |
| >SNP8NRG861223__allelePos=201 total len = 401 SNP=R chr8 | SEQ ID NO:773 |
| >SNP8NRG862179__allelePos=201 total len = 401 SNP=Y chr8 | SEQ ID NO:774 |
| >SNP8NRG862707__allelePos=201 total len = 401 SNP=R chr8 | SEQ ID NO:775 |
| >SNP8NRG863129__allelePos=201 total len = 401 SNP=Y chr8 | SEQ ID NO:776 |
| >SNP8NRG863140__allelePos=201 total len = 401 SNP=M chr8 | SEQ ID NO:777 |
| >SNP8NRG866626__allelePos=201 total len = 401 SNP=Y chr8 | SEQ ID NO:778 |
| >SNP8NRG871644__allelePos=201 total len = 401 SNP=Y chr8 | SEQ ID NO:779 |
| >SNP8NRG872765__allelePos=201 total len = 401 SNP=R chr8 | SEQ ID NO:780 |
| >SNP8NRG879050__allelePos=201 total len = 401 SNP=R chr8 | SEQ ID NO:781 |
| >SNP8NRG880333__allelePos=201 total len = 401 SNP=R chr8 | SEQ ID NO:782 |
| >SNP8NRG880710__allelePos=201 total len = 401 SNP=S chr8 | SEQ ID NO:783 |
| >SNP8NRG881706__a1lelePos=201 total len = 401 SNP=W chr8 | SEQ ID NO:784 |
| >SNP8NRG881762__allelePos=201 total len = 401 SNP=Y chr8 | SEQ ID NO:785 |
| >SNP8NRG881912__allelePos=201 total len = 401 SNP=Y chr8 | SEQ ID NO:786 |
| >SNP8NRG882059__allelePos=201 total len = 401 SNP=Y chr8 | SEQ ID NO:787 |
| >SNP8NRG886225__allelePos=201 total len = 401 SNP=R chr8 | SEQ ID NO:788 |
| >SNP8NRG886728__allelePos=201 total len = 401 SNP=R chr8 | SEQ ID NO:789 |
| >SNP8NRG887098__allelePos=201 total len = 401 SNP=W chr8 | SEQ ID NO:790 |
| >SNP8NRG888211__allelePos=201 total len = 401 SNP=R chr8 | SEQ ID NO:791 |
| >SNP8NRG888516__allelePos=201 total len = 401 SNP=Y chr8 | SEQ ID NO:792 |
| >SNP8NRG888859__allelePos=201 total len = 401 SNP=K chr8 | SEQ ID NO:793 |
| >SNP8NRG888984__allelePos=201 total len = 401 SNP=R chr8 | SEQ ID NO:794 |
| >SNP8NRG889499__allelePos=201 total len = 401 SNP=M chr8 | SEQ ID NO:795 |

TABLE 2-continued

Microsatellites, SNP's, and insertions/deletions in the 1.5 Mb sequence.

| | |
|---|---|
| >SNP8NRG889503__allelePos=201 total len = 401 SNP=M chr8 | SEQ ID NO:796 |
| >SNP8NRG889527__allelePos=201 total len = 401 SNP=M chr8 | SEQ ID NO:797 |
| >SNP8NRG889532__allelePos=201 total len = 401 SNP=Y chr8 | SEQ ID NO:798 |
| >SNP8NRG889600__allelePos=201 total len = 401 SNP=S chr8 | SEQ ID NO:799 |
| >SNP8NRG889616__allelePos=201 total len = 401 SNP=W chr8 | SEQ ID NO:800 |
| >SNP8NRG890254__allelePos=201 total len = 401 SNP=S chr8 | SEQ ID NO:801 |
| >SNP8NRG890931__allelePos=201 total len = 401 SNP=R chr8 | SEQ ID NO:802 |
| >SNP8NRG895473__allelePos=201 total len = 401 SNP=K chr8 | SEQ ID NO:803 |
| >SNP8NRG896291__allelePos=201 total len = 401 SNP=R chr8 | SEQ ID NO:804 |
| >SNP8NRG897559__allelePos=201 total len = 401 SNP=Y chr8 | SEQ ID NO:805 |
| >SNP8NRG898013__allelePos=201 total len = 401 SNP=Y chr8 | SEQ ID NO:806 |
| >SNP8NRG898791__allelePos=201 total len = 401 SNP=Y chr8 | SEQ ID NO:807 |
| >SNP8NRG900832__allelePos=201 total len = 401 SNP=R chr8 | SEQ ID NO:808 |
| >SNP8NRG901339__allelePos=201 total len = 401 SNP=R chr8 | SEQ ID NO:809 |
| >SNP8NRG902867__allelePos=201 total len = 401 SNP=K chr8 | SEQ ID NO:810 |
| >SNP8NRG903255__allelePos=201 total len = 401 SNP=K chr8 | SEQ ID NO:811 |
| >SNP8NRG903311__allelePos=201 total len = 401 SNP=Y chr8 | SEQ ID NO:812 |
| >SNP8NRG903387__allelePos=201 total len = 401 SNP=M chr8 | SEQ ID NO:813 |
| >SNP8NRG904534__allelePos=201 total len = 401 SNP=R chr8 | SEQ ID NO:814 |
| >SNP8NRG904877__allelePos=201 total len = 401 SNP=S chr8 | SEQ ID NO:815 |
| >SNP8NRG906451__allelePos=201 total len = 401 SNP=K chr8 | SEQ ID NO:816 |
| >SNP8NRG906520__allelePos=201 total len = 401 SNP=R chr8 | SEQ ID NO:817 |
| >SNP8NRG906595__allelePos=201 total len = 401 SNP=Y chr8 | SEQ ID NO:818 |
| >SNP8NRG907716__allelePos=201 total len = 401 SNP=W chr8 | SEQ ID NO:819 |
| >SNP8NRG908003__allelePos=201 total len = 401 SNP=Y chr8 | SEQ ID NO:820 |
| >SNP8NRG908169__allelePos=201 total len = 401 SNP=Y chr8 | SEQ ID NO:821 |
| >SNP8NRG909966__allelePos=201 total len = 401 SNP=R chr8 | SEQ ID NO:822 |
| >SNP8NRG910888__allelePos=201 total len = 401 SNP=K chr8 | SEQ ID NO:823 |
| >SNP8NRG911200__allelePos=201 total len = 401 SNP=K chr8 | SEQ ID NO:824 |
| >SNP8NRG911948__allelePos=201 total len = 401 SNP=Y chr8 | SEQ ID NO:825 |
| >SNP8NRG912456__allelePos=201 total len = 401 SNP=K chr8 | SEQ ID NO:826 |
| >SNP8NRG913539__allelePos=201 total len = 401 SNP=S chr8 | SEQ ID NO:827 |
| >SNP8NRG914399__allelePos=201 total len = 401 SNP=W chr8 | SEQ ID NO:828 |
| >SNP8NRG914902__allelePos=201 total len = 401 SNP=K chr8 | SEQ ID NO:829 |
| >SNP8NRG915792__allelePos=201 total len = 401 SNP=Y chr8 | SEQ ID NO:830 |
| >SNP8NRG917096__allelePos=201 total len = 401 SNP=M chr8 | SEQ ID NO:831 |
| >SNP8NRG917995__allelePos=201 total len = 401 SNP=Y chr8 | SEQ ID NO:832 |
| >SNP8NRG918237__allelePos=201 total len = 401 SNP=R chr8 | SEQ ID NO:833 |
| >SNP8NRG918733__allelePos=201 total len = 401 SNP=M chr8 | SEQ ID NO:834 |
| >SNP8NRG919673__allelePos=201 total len = 401 SNP=Y chr8 | SEQ ID NO:835 |
| >SNP8NRG924154__allelePos=201 total len = 401 SNP=M chr8 | SEQ ID NO:836 |
| >SNP8NRG924440__allelePos=201 total len = 401 SNP=R chr8 | SEQ ID NO:837 |
| >SNP8NRG924860__allelePos=201 total len = 401 SNP=R chr8 | SEQ ID NO:838 |
| >SNP8NRG925007__allelePos=201 total len = 401 SNP=R chr8 | SEQ ID NO:839 |
| >SNP8NRG927702__allelePos=201 total len = 401 SNP=R chr8 | SEQ ID NO:840 |
| >SNP8NRG927909__allelePos=201 total len = 401 SNP=R chr8 | SEQ ID NO:841 |
| >SNP8NRG933401__allelePos=201 total len = 401 SNP=Y chr8 | SEQ ID NO:842 |
| >SNP8NRG939408__allelePos=201 total len = 401 SNP=R chr8 | SEQ ID NO:843 |
| >SNP8NRG941153__allelePos=201 total len = 401 SNP=W chr8 | SEQ ID NO:844 |
| >SNP8NRG944063__allelePos=201 total len = 401 SNP=S chr8 | SEQ ID NO:845 |
| >SNP8NRG945384__allelePos=201 total len = 401 SNP=R chr8 | SEQ ID NO:846 |
| >SNP8NRG946599__allelePos=201 total len = 401 SNP=Y chr8 | SEQ ID NO:847 |
| >SNP8NRG946608__allelePos=201 total len = 401 SNP=M chr8 | SEQ ID NO:848 |
| >SNP8NRG948516__allelePos=201 total len = 401 SNP=R chr8 | SEQ ID NO:849 |
| >SNP8NRG948606__allelePos=201 total len = 401 SNP=R chr8 | SEQ ID NO:850 |
| >SNP8NRG950029__allelePos=201 total len = 401 SNP=S chr8 | SEQ ID NO:851 |
| >SNP8NRG952130__allelePos=201 total len = 401 SNP=Y chr8 | SEQ ID NO:852 |
| >SNP8NRG952315__allelePos=201 total len = 401 SNP=Y chr8 | SEQ ID NO:853 |
| >SNP8NRG952840__allelePos=201 total len = 401 SNP=R chr8 | SEQ ID NO:854 |
| >SNP8NRG954510__allelePos=201 total len = 401 SNP=W chr8 | SEQ ID NO:855 |
| >SNP8NRG954665__allelePos=201 total len = 401 SNP=Y chr8 | SEQ ID NO:856 |
| >SNP8NRG955518__allelePos=201 total len = 401 SNP=R chr8 | SEQ ID NO:857 |
| >SNP8NRG957595__allelePos=201 total len = 401 SNP=Y chr8 | SEQ ID NO:858 |
| >SNP8NRG957774__allelePos=201 total len = 401 SNP=Y chr8 | SEQ ID NO:859 |
| >SNP8NRG957922__allelePos=201 total len = 401 SNP=K chr8 | SEQ ID NO:860 |
| >SNP8NRG957969__allelePos=201 total len = 401 SNP=B chr8 | SEQ ID NO:861 |
| >SNP8NRG958536__allelePos=201 total len = 401 SNP=Y chr8 | SEQ ID NO:862 |
| >SNP8NRG958857__allelePos=201 total len = 401 SNP=Y chr8 | SEQ ID NO:863 |
| >SNP8NRG959653__allelePos=201 total len = 401 SNP=Y chr8 | SEQ ID NO:864 |
| >SNP8NRG959711__allelePos=201 total len = 401 SNP=Y chr8 | SEQ ID NO:865 |
| >SNP8NRG961073__allelePos=201 total len = 401 SNP=M chr8 | SEQ ID NO:866 |
| >SNP8NRG963095__allelePos=201 total len = 401 SNP=R chr8 | SEQ ID NO:867 |
| >SNP8NRG964718__allelePos=201 total len = 401 SNP=Y chr8 | SEQ ID NO:868 |
| >SNP8NRG968345__allelePos=201 total len = 401 SNP=R chr8 | SEQ ID NO:869 |
| >SNP8NRG968552__allelePos=201 total len = 401 SNP=R chr8 | SEQ ID NO:870 |
| >SNP8NRG968905__allelePos=201 total len = 401 SNP=R chr8 | SEQ ID NO:871 |
| >SNP8NRG970142__allelePos=201 total len = 401 SNP=W chr8 | SEQ ID NO:872 |

TABLE 2-continued

Microsatellites, SNP's, and insertions/deletions in the 1.5 Mb sequence.

| | |
|---|---|
| >SNP8NRG970426__allelePos=201 total len = 401 SNP=Y chr8 | SEQ ID NO:873 |
| >SNP8NRG971673__allelePos=201 total len = 401 SNP=W chr8 | SEQ ID NO:874 |
| >SNP8NRG975429__allelePos=201 total len = 401 SNP=Y chr8 | SEQ ID NO:875 |
| >SNP8NRG975591__allelePos=201 total len = 401 SNP=Y chr8 | SEQ ID NO:876 |
| >SNP8NRG975902__allelePos=201 total len = 401 SNP=R chr8 | SEQ ID NO:877 |
| >SNP8NRG975904__allelePos=201 total len = 401 SNP=M chr8 | SEQ ID NO:878 |
| >SNP8NRG975910__allelePos=201 total len = 401 SNP=W chr8 | SEQ ID NO:879 |
| >SNP8NRG976185__allelePos=201 total len = 401 SNP=Y chr8 | SEQ ID NO:880 |
| >SNP8NRG976339__allelePos=201 total len = 401 SNP=Y chr8 | SEQ ID NO:881 |
| >SNP8NRG976854__allelePos=201 total len = 401 SNP=K chr8 | SEQ ID NO:882 |
| >SNP8NRG977028__allelePos=201 total len = 401 SNP=W chr8 | SEQ ID NO:883 |
| >SNP8NRG978926__allelePos=201 total len = 401 SNP=M chr8 | SEQ ID NO:884 |
| >SNP8NRG980337__allelePos=201 total len = 401 SNP=R chr8 | SEQ ID NO:885 |
| >SNP8NRG980391__allelePos=201 total len = 401 SNP=R chr8 | SEQ ID NO:886 |
| >SNP8NRG980876__allelePos=201 total len = 401 SNP=Y chr8 | SEQ ID NO:887 |
| >SNP8NRG981087__allelePos=201 total len = 401 SNP=W chr8 | SEQ ID NO:888 |
| >SNP8NRG981623__allelePos=201 total len = 401 SNP=R chr8 | SEQ ID NO:889 |
| >SNP8NRG982292__allelePos=201 total len = 401 SNP=R chr8 | SEQ ID NO:890 |
| >SNP8NRG982439__allelePos=201 total len = 401 SNP=R chr8 | SEQ ID NO:891 |
| >SNP8NRG982535__allelePos=201 total len = 401 SNP=Y chr8 | SEQ ID NO:892 |
| >SNP8NRG983391__allelePos=201 total len = 401 SNP=Y chr8 | SEQ ID NO:893 |
| >SNP8NRG983576__allelePos=201 total len = 401 SNP=R chr8 | SEQ ID NO:894 |
| >SNP8NRG983658__allelePos=201 total len = 401 SNP=W chr8 | SEQ ID NO:895 |
| >SNP8NRG983795__allelePos=201 total len = 401 SNP=S chr8 | SEQ ID NO:896 |
| >SNP8NRG984008__allelePos=201 total len = 401 SNP=R chr8 | SEQ ID NO:897 |
| >SNP8NRG986427__allelePos=201 total len = 401 SNP=Y chr8 | SEQ ID NO:898 |
| >SNP8NRG987097__allelePos=201 total len = 401 SNP=K chr8 | SEQ ID NO:899 |
| >SNP8NRG987360__allelePos=201 total len = 401 SNP=M chr8 | SEQ ID NO:900 |
| >SNP8NRG988929__allelePos=201 total len = 401 SNP=Y chr8 | SEQ ID NO:901 |
| >SNP8NRG989310__allelePos=201 total len = 401 SNP=R chr8 | SEQ ID NO:902 |
| >SNP8NRG989590__allelePos=201 total len = 401 SNP=R chr8 | SEQ ID NO:903 |
| >SNP8NRG989865__allelePos=201 total len = 401 SNP=R chr8 | SEQ ID NO:904 |
| >SNP8NRG990875__allelePos=201 total len = 401 SNP=R chr8 | SEQ ID NO:905 |
| >SNP8NRG990877__allelePos=201 total len = 401 SNP=W chr8 | SEQ ID NO:906 |
| >SNP8NRG991343__allelePos=201 total len = 401 SNP=R chr8 | SEQ ID NO:907 |
| >SNP8NRG991385__allelePos=201 total len = 401 SNP=R chr8 | SEQ ID NO:908 |
| >SNP8NRG992001__allelePos=201 total len = 401 SNP=W chr8 | SEQ ID NO:909 |
| >SNP8NRG993049__allelePos=201 total len = 401 SNP=K chr8 | SEQ ID NO:910 |
| >SNP8NRG994284__allelePos=201 total len = 401 SNP=R chr8 | SEQ ID NO:911 |
| >SNP8NRG994731__allelePos=201 total len = 401 SNP=R chr8 | SEQ ID NO:912 |
| >SNP8NRG994801__allelePos=201 total len = 401 SNP=W chr8 | SEQ ID NO:913 |
| >SNP8NRG995251__allelePos=201 total len = 401 SNP=M chr8 | SEQ ID NO:914 |
| >SNP8NRG995465__allelePos=201 total len = 401 SNP=R chr8 | SEQ ID NO:915 |
| >SNP8NRG995529__allelePos=201 total len = 401 SNP=S chr8 | SEQ ID NO:916 |
| >SNP8NRG996334__allelePos=201 total len = 401 SNP=W chr8 | SEQ ID NO:917 |
| >SNP8NRG997541__allelePos=201 total len = 401 SNP=R chr8 | SEQ ID NO:918 |
| >SNP8NRG999080__allelePos=201 total len = 401 SNP=Y chr8 | SEQ ID NO:919 |
| >SNP8NRG999723__allelePos=201 total len = 401 SNP=W chr8 | SEQ ID NO:920 |
| >SNP8NRG1000240__allelePos=201 total len = 401 SNP=M chr8 | SEQ ID NO:921 |
| >SNP8NRG1000494__allelePos=201 total len = 401 SNP=K chr8 | SEQ ID NO:922 |
| >SNP8NRG1001640__allelePos=201 total len = 401 SNP=Y chr8 | SEQ ID NO:923 |
| >SNP8NRG1001909__allelePos=201 total len = 401 SNP=M chr8 | SEQ ID NO:924 |
| >SNP8NRG1002168__allelePos=201 total len = 401 SNP=R chr8 | SEQ ID NO:925 |
| >SNP8NRG1002347__allelePos=201 total len = 401 SNP=Y chr8 | SEQ ID NO:926 |
| >SNP8NRG1002489__allelePos=201 total len = 401 SNP=W chr8 | SEQ ID NO:927 |
| >SNP8NRG1002490__allelePos=201 total len = 401 SNP=M chr8 | SEQ ID NO:928 |
| >SNP8NRG1005338__allelePos=201 total len = 401 SNP=M chr8 | SEQ ID NO:929 |
| >SNP8NRG1006758__allelePos=201 total len = 401 SNP=R chr8 | SEQ ID NO:930 |
| >SNP8NRG1007029__allelePos=201 total len = 401 SNP=Y chr8 | SEQ ID NO:931 |
| >SNP8NRG1007161__allelePos=201 total len = 401 SNP=R chr8 | SEQ ID NO:932 |
| >SNP8NRG1007492__allelePos=201 total len = 401 SNP=K chr8 | SEQ ID NO:933 |
| >SNP8NRG1007S22__allelePos=201 total len = 401 SNP=Y chr8 | SEQ ID NO:934 |
| >SNP8NRG1008327__allelePos=201 total len = 401 SNP=Y chr8 | SEQ ID NO:935 |
| >SNP8NRG1009154__allelePos=201 total len = 401 SNP=R chr8 | SEQ ID NO:936 |
| >SNP8NRG1009558__allelePos=201 total len = 401 SNP=Y chr8 | SEQ ID NO:937 |
| >SNP8NRG1010792__allelePos=201 total len = 401 SNP=W chr8 | SEQ ID NO:938 |
| >SNP8NRG1011358__allelePos=201 total len = 401 SNP=R chr8 | SEQ ID NO:939 |
| >SNP8NRG1011526__allelePos=201 total len = 401 SNP=R chr8 | SEQ ID NO:940 |
| >SNP8NRG1013903__allelePos=201 total len = 401 SNP=Y chr8 | SEQ ID NO:941 |
| >SNP8NRG1016740__allelePos=201 total len = 401 SNP=W chr8 | SEQ ID NO:942 |
| >SNP8NRG1016775__allelePos=201 total len = 401 SNP=W chr8 | SEQ ID NO:943 |
| >SNP8NRG1017450__allelePos=201 total len = 401 SNP=Y chr8 | SEQ ID NO:944 |
| >SNP8NRG1017559__allelePos=201 total len = 401 SNP=Y chr8 | SEQ ID NO:945 |
| >SNP8NRG1019430__allelePos=201 total len = 401 SNP=R chr8 | SEQ ID NO:946 |
| >SNP8NRG1020682__allelePos=201 total len = 401 SNP=Y chr8 | SEQ ID NO:947 |
| >SNP8NRG1021012__allelePos=201 total len = 401 SNP=Y chr8 | SEQ ID NO:948 |
| >SNP8NRG1021078__allelePos=201 total len = 401 SNP=R chr8 | SEQ ID NO:949 |

TABLE 2-continued

Microsatellites, SNP's, and insertions/deletions in the 1.5 Mb sequence.

| | |
|---|---|
| >SNP8NRG1021666_allelePos=201 total len = 401 SNP=Y chr8 | SEQ ID NO:950 |
| >SNP8NRG1021687_allelePos=201 total len = 401 SNP=K chr8 | SEQ ID NO:951 |
| >SNP8NRG1022025_allelePos=201 total len = 401 SNP=Y chr8 | SEQ ID NO:952 |
| >SNP8NRG1024324_allelePos=201 total len = 401 SNP=Y chr8 | SEQ ID NO:953 |
| >SNP8NRG1024505_allelePos=201 total len = 401 SNP=M chr8 | SEQ ID NO:954 |
| >SNP8NRG1024598_allelePos=201 total len = 401 SNP=R chr8 | SEQ ID NO:955 |
| >SNP8NRG1025427_allelePos=201 total len = 401 SNP=W chr8 | SEQ ID NO:956 |
| >SNP8NRG1026138_allelePos=201 total len = 401 SNP=R chr8 | SEQ ID NO:957 |
| >SNP8NRG1027681_allelePos=201 total len = 401 SNP=R chr8 | SEQ ID NO:958 |
| >SNP8NRG1030217_allelePos=201 total len = 401 SNP=R chr8 | SEQ ID NO:959 |
| >SNP8NRG1030817_allelePos=201 total len = 401 SNP=R chr8 | SEQ ID NO:960 |
| >SNP8NRG1033196_allelePos=201 total len = 401 SNP=K chr8 | SEQ ID NO:961 |
| >SNP8NRG1033262_allelePos=201 total len = 401 SNP=R chr8 | SEQ ID NO:962 |
| >SNP8NRG1033263_allelePos=201 total len = 401 SNP=R chr8 | SEQ ID NO:963 |
| >SNP8NRG1035657_allelePos=201 total len = 401 SNP=Y chr8 | SEQ ID NO:964 |
| >SNP8NRG1035864_allelePos=201 total len = 401 SNP=K chr8 | SEQ ID NO:965 |
| >SNP8NRG1041189_allelePos=201 total len = 401 SNP=S chr8 | SEQ ID NO:966 |
| >SNP8NR01041327_allelePos=201 total len = 401 SNP=Y chr8 | SEQ ID NO:967 |
| >SNP8NRG1042979_allelePos=201 total len = 401 SNP=R chr8 | SEQ ID NO:968 |
| >SNP8NRG1043231_allelePos=201 total len = 401 SNP=S chr8 | SEQ ID NO:969 |
| >SNP8NRG1044228_allelePos=201 total len = 401 SNP=Y chr8 | SEQ ID NO:970 |
| >SNP8NRG1050090_allelePos=201 total len = 401 SNP=Y chr8 | SEQ ID NO:971 |
| >SNP8NRG1050818_allelePos=201 total len = 401 SNP=W chr8 | SEQ ID NO:972 |
| >SNP8NRG1051118_allelePos=201 total len = 401 SNP=K chr8 | SEQ ID NO:973 |
| >SNP8NRG1052472_allelePos=201 total len = 401 SNP=Y chr8 | SEQ ID NO:974 |
| >SNP8NRG1052592_allelePos=201 total len = 401 SNP=K chr8 | SEQ ID NO:975 |
| >SNP8NRG1052642_allelePos=201 total len = 401 SNP=Y chr8 | SEQ ID NO:976 |
| >SNP8NRG1053241_allelePos=201 total len = 401 SNP=Y chr8 | SEQ ID NO:977 |
| >SNP8NRG1053476_allelePos=201 total len = 401 SNP=R chr8 | SEQ ID NO:978 |
| >SNP8NRG1054505_allelePos=201 total len = 401 SNP=Y chr8 | SEQ ID NO:979 |
| >SNP8NRG1055802_allelePos=201 total len = 401 SNP=R chr8 | SEQ ID NO:980 |
| >SNP8NRG1055823_allelePos=201 total len = 401 SNP=Y chr8 | SEQ ID NO:981 |
| >SNP8NRG1056346_allelePos=201 total len = 401 SNP=M chr8 | SEQ ID NO:982 |
| >SNP8NRG1059642_allelePos=201 total len = 401 SNP=K chr8 | SEQ ID NO:983 |
| >SNP8NRG1059758_allelePos=201 total len = 401 SNP=R chr8 | SEQ ID NO:984 |
| >SNP8NRG1059805_allelePos=201 total len = 401 SNP=R chr8 | SEQ ID NO:985 |
| >SNP8NRG1063211_allelePos=201 total len = 401 SNP=Y chr8 | SEQ ID NO:986 |
| >SNP8NRG1064262_allelePos=201 total len = 401 SNP=R chr8 | SEQ ID NO:987 |
| >SNP8NRG1065961_allelePos=201 total len = 401 SNP=R chr8 | SEQ ID NO:988 |
| >SNP8NRG1070770_allelePos=201 total len = 401 SNP=K chr8 | SEQ ID NO:989 |
| >SNP8NRG1071757_allelePos=201 total len = 401 SNP=W chr8 | SEQ ID NO:990 |
| >SNP8NRG1072396_allelePos=201 total len = 401 SNP=R chr8 | SEQ ID NO:991 |
| >SNP8NRG1072954_allelePos=201 total len = 401 SNP=S chr8 | SEQ ID NO:992 |
| >SNP8NRG1073158_allelePos=201 total len = 401 SNP=Y chr8 | SEQ ID NO:993 |
| >SNP8NRG1073175_allelePos=201 total len = 401 SNP=S chr8 | SEQ ID NO:994 |
| >SNP8NRG1073449_allelePos=201 total len = 401 SNP=R chr8 | SEQ ID NO:995 |
| >SNP8NRG1074074_allelePos=201 total len = 401 SNP=R chr8 | SEQ ID NO:996 |
| >SNP8NRG1074140_allelePos=201 total len = 401 SNP=R chr8 | SEQ ID NO:997 |
| >SNP8NRG1074713_allelePos=201 total len = 401 SNP=R chr8 | SEQ ID NO:998 |
| >SNP8NRG1074905_allelePos=201 total len = 401 SNP=W chr8 | SEQ ID NO:999 |
| >SNP8NRG1075359_allelePos=201 total len = 401 SNP=S chr8 | SEQ ID NO:1000 |
| >SNP8NRG1075432_allelePos=201 total len = 401 SNP=R chr8 | SEQ ID NO:1001 |
| >SNP8NRG1075912_allelePos=201 total len = 401 SNP=R chr8 | SEQ ID NO:1002 |
| >SNP8NRG1075926_allelePos=201 total len = 401 SNP=Y chr8 | SEQ ID NO:1003 |
| >SNP8NRG1077472_allelePos=201 total len = 401 SNP=Y chr8 | SEQ ID NO:1004 |
| >SNP8NRG1077504_allelePos=201 total len = 401 SNP=Y chr8 | SEQ ID NO:1005 |
| >SNP8NRG1077529_allelePos=201 total len = 401 SNP=Y chr8 | SEQ ID NO:1006 |
| >SNP8NRG1077826_allelePos=201 total len = 401 SNP=Y chr8 | SEQ ID NO:1007 |
| >SNP8NRG1078867_allelePos=201 total len = 401 SNP=Y chr8 | SEQ ID NO:1008 |
| >SNP8NRG1079133_allelePos=201 total len = 401 SNP=Y chr8 | SEQ ID NO:1009 |
| >SNP8NRG1080162_allelePos=201 total len = 401 SNP=Y chr8 | SEQ ID NO:1010 |
| >SNP8NRG1080340_allelePos=201 total len = 401 SNP=R chr8 | SEQ ID NO:1011 |
| >SNP8NRG1081302_allelePos=201 total len = 401 SNP=W chr8 | SEQ ID NO:1012 |
| >SNP8NRG1081346_allelePos=201 total len = 401 SNP=R chr8 | SEQ ID NO:1013 |
| >SNP8NRG1081690_allelePos=201 total len = 401 SNP=Y chr8 | SEQ ID NO:1014 |
| >SNP8NRG1082234_allelePos=201 total len = 401 SNP=K chr8 | SEQ ID NO:1015 |
| >SNP8NRG1084388_allelePos=201 total len = 401 SNP=R chr8 | SEQ ID NO:1016 |
| >SNP8NRG1084888_allelePos=201 total len = 401 SNP=R chr8 | SEQ ID NO:1017 |
| >SNP8NRG1084948_allelePos=201 total len = 401 SNP=R chr8 | SEQ ID NO:1018 |
| >SNP8NRG1085057_allelePos=201 total len = 401 SNP=Y chr8 | SEQ ID NO:1019 |
| >SNP8NRG1085579_allelePos=201 total len = 401 SNP=W chr8 | SEQ ID NO:1020 |
| >SNP8NRG1085768_allelePos=201 total len = 401 SNP=R chr8 | SEQ ID NO:1021 |
| >SNP8NRG1085843_allelePos=201 total len = 401 SNP=R chr8 | SEQ ID NO:1022 |
| >SNP8NRG1086222_allelePos=201 total len = 401 SNP=Y chr8 | SEQ ID NO:1023 |
| >SNP8NRG1086670_allelePos=201 total len = 401 SNP=W chr8 | SEQ ID NO:1024 |
| >SNP8NRG1086728_allelePos=201 total len = 401 SNP=R chr8 | SEQ ID NO:1025 |
| >SNP8NRG1086908_allelePos=201 total len = 401 SNP=M chr8 | SEQ ID NO:1026 |

TABLE 2-continued

Microsatellites, SNP's, and insertions/deletions in the 1.5 Mb sequence.

| | |
|---|---|
| >SNP8NRG1087118_allelePos=201 total len = 401 SNP=R chr8 | SEQ ID NO:1027 |
| >SNP8NRG1087240_allelePos=201 total len = 401 SNP=R chr8 | SEQ ID NO:1028 |
| >SNP8NRG1087428_allelePos=201 total len = 401 SNP=S chr8 | SEQ ID NO:1029 |
| >SNP8NRG1087820_allelePos=201 total len = 401 SNP=R chr8 | SEQ ID NO:1030 |
| >SNP8NRG1088704_allelePos=201 total len = 401 SNP=R chr8 | SEQ ID NO:1031 |
| >SNP8NRG1089013_allelePos=201 total len = 401 SNP=R chr8 | SEQ ID NO:1032 |
| >SNP8NRG1089629_allelePos=201 total len = 401 SNP=Y chr8 | SEQ ID NO:1033 |
| >SNP8NRG1090228_allelePos=201 total len = 401 SNP=Y chr8 | SEQ ID NO:1034 |
| >SNP8NRG1091105_allelePos=201 total len = 401 SNP=Y chr8 | SEQ ID NO:1035 |
| >SNP8NRG1091106_allelePos=201 total len = 401 SNP=R chr8 | SEQ ID NO:1036 |
| >SNP8NRG1091332_allelePos=201 total len = 401 SNP=W chr8 | SEQ ID NO:1037 |
| >SNP8NRG1091369_allelePos=201 total len = 401 SNP=M chr8 | SEQ ID NO:1038 |
| >SNP8NRG1091740_allelePos=201 total len = 401 SNP=Y chr8 | SEQ ID NO:1039 |
| >SNP8NRG1092329_allelePos=201 total len = 401 SNP=Y chr8 | SEQ ID NO:1040 |
| >SNP8NRG1092343_allelePos=201 total len = 401 SNP=R chr8 | SEQ ID NO:1041 |
| >SNP8NRG1092685_allelePos=201 total len = 401 SNP=Y chr8 | SEQ ID NO:1042 |
| >SNP8NRG1093149_allelePos=201 total len = 401 SNP=K chr8 | SEQ ID NO:1043 |
| >SNP8NRG1093230_allelePos=201 total len = 401 SNP=Y chr8 | SEQ ID NO:1044 |
| >SNP8NRG1093250_allelePos=201 total len = 401 SNP=R chr8 | SEQ ID NO:1045 |
| >SNP8NRG1093832_allelePos=201 total len = 401 SNP=R chr8 | SEQ ID NO:1046 |
| >SNP8NRG1093969_allelePos=201 total len = 401 SNP=Y chr8 | SEQ ID NO:1047 |
| >SNP8NRG1094264_allelePos=201 total len = 401 SNP=R chr8 | SEQ ID NO:1048 |
| >SNP8NRG1094391_allelePos=201 total len = 401 SNP=S chr8 | SEQ ID NO:1049 |
| >SNP8NRG1094767_allelePos=201 total len = 401 SNP=S chr8 | SEQ ID NO:1050 |
| >SNP8NRG1094784_allelePos=201 total len = 401 SNP=S chr8 | SEQ ID NO:1051 |
| >SNP8NRG1095625_allelePos=201 total len = 401 SNP=R chr8 | SEQ ID NO:1052 |
| >SNP8NRG1095986_allelePos=201 total len = 401 SNP=R chr8 | SEQ ID NO:1053 |
| >SNP8NRG1096319_allelePos=201 total len = 401 SNP=R chr8 | SEQ ID NO:1054 |
| >SNP8NRG1096411_allelePos=201 total len = 401 SNP=R chr8 | SEQ ID NO:1055 |
| >SNP8NRG1097191_allelePos=201 total len = 401 SNP=M chr8 | SEQ ID NO:1056 |
| >SNP8NRG1097583_allelePos=201 total len = 401 SNP=R chr8 | SEQ ID NO:1057 |
| >SNP8NRG1098672_allelePos=201 total len = 401 SNP=R chr8 | SEQ ID NO:1058 |
| >SNP8NRG1098870_allelePos=201 total len = 401 SNP=Y chr8 | SEQ ID NO:1059 |
| >SNP8NRG1099281_allelePos=201 total len = 401 SNP=Y chr8 | SEQ ID NO:1060 |
| >SNP8NRG1100717_allelePos=201 total len = 401 SNP=Y chr8 | SEQ ID NO:1061 |
| >SNP8NRG1101278_allelePos=201 total len = 401 SNP=K chr8 | SEQ ID NO:1062 |
| >SNP8NRG1101507_allelePos=201 total len = 401 SNP=K chr8 | SEQ ID NO:1063 |
| >SNP8NRG1101681_allelePos=201 total len = 401 SNP=K chr8 | SEQ ID NO:1064 |
| >SNP8NRG1101701_allelePos=201 total len = 401 SNP=Y chr8 | SEQ ID NO:1065 |
| >SNP8NRG1101907_allelePos=201 total len = 401 SNP=K chr8 | SEQ ID NO:1066 |
| >SNP8NRG1102723_allelePos=201 total len = 401 SNP=Y chr8 | SEQ ID NO:1067 |
| >SNP8NRG1102729_allelePos=201 total len = 401 SNP=Y chr8 | SEQ ID NO:1068 |
| >SNP8NRG1102907_allelePos=201 total len = 401 SNP=R chr8 | SEQ ID NO:1069 |
| >SNP8NRG1103158_allelePos=201 total len = 401 SNP=R chr8 | SEQ ID NO:1070 |
| >SNP8NRG1104559_allelePos=201 total len = 401 SNP=R chr8 | SEQ ID NO:1071 |
| >SNP8NRG1104831_allelePos=201 total len = 401 SNP=R chr8 | SEQ ID NO:1072 |
| >SNP8NRG1106244_allelePos=201 total len = 401 SNP=R chr8 | SEQ ID NO:1073 |
| >SNP8NRG1106245_allelePos=201 total len = 401 SNP=W chr8 | SEQ ID NO:1074 |
| >SNP8NRG1106280_allelePos=201 total len = 401 SNP=Y chr8 | SEQ ID NO:1075 |
| >SNP8NRG1106349_allelePos=201 total len = 401 SNP=Y chr8 | SEQ ID NO:1076 |
| >SNP8NRG1107164_allelePos=201 total len = 401 SNP=R chr8 | SEQ ID NO:1077 |
| >SNP8NRG1107173_allelePos=201 total len = 401 SNP=Y chr8 | SEQ ID NO:1078 |
| >SNP8NRG1107757_allelePos=201 total len = 401 SNP=K chr8 | SEQ ID NO:1079 |
| >SNP8NRG1107813_allelePos=201 total len = 401 SNP=Y chr8 | SEQ ID NO:1080 |
| >SNP8NRG1108109_allelePos=201 total len = 401 SNP=Y chr8 | SEQ ID NO:1081 |
| >SNP8NRG1108375_allelePos=201 total len = 401 SNP=Y chr8 | SEQ ID NO:1082 |
| >SNP8NRG1109352_allelePos=201 total len = 401 SNP=M chr8 | SEQ ID NO:1083 |
| >SNP8NRG1109518_allelePos=201 total len = 401 SNP=Y chr8 | SEQ ID NO:1084 |
| >SNP8NRG1110232_allelePos=201 total len = 401 SNP=R chr8 | SEQ ID NO:1085 |
| >SNP8NRG1110825_allelePos=201 total len = 401 SNP=M chr8 | SEQ ID NO:1086 |
| >SNP8NRG1113329_allelePos=201 total len = 401 SNP=W chr8 | SEQ ID NO:1087 |
| >SNP8NRG1113984_allelePos=201 total len = 401 SNP=Y chr8 | SEQ ID NO:1088 |
| >SNP8NRG1114175_allelePos=201 total len = 401 SNP=Y chr8 | SEQ ID NO:1089 |
| >SNP8NRG1116260_allelePos=201 total len = 401 SNP=Y chr8 | SEQ ID NO:1090 |
| >SNP8NRG1118220_allelePos=201 total len = 401 SNP=R chr8 | SEQ ID NO:1091 |
| >SNP8NRG1140135_allelePos=201 total len = 401 SNP=Y chr8 | SEQ ID NO:1092 |
| >SNP8NRG1184279_allelePos=201 total len = 401 SNP=K chr8 | SEQ ID NO:1093 |
| >SNP8NRG1208516_allelePos=201 total len = 401 SNP=S chr8 | SEQ ID NO:1094 |
| >SNP8NRG1208518_allelePos=201 total len = 401 SNP=K chr8 | SEQ ID NO:1095 |
| >SNP8NRG1229502_allelePos=201 total len = 401 SNP=Y chr8 | SEQ ID NO:1096 |
| >SNP8NRG1252121_allelePos=201 total len = 401 SNP=M chr8 | SEQ ID NO:1097 |
| >SNP8NRG1253799_allelePos=201 total len = 401 SNP=K chr8 | SEQ ID NO:1098 |
| >SNP8NRG1253879_allelePos=201 total len = 401 SNP=W chr8 | SEQ ID NO:1099 |
| >SNP8NRG1254271_allelePos=201 total len = 401 SNP=R chr8 | SEQ ID NO:1100 |
| >SNP8NRG1254314_allelePos=201 total len = 401 SNP=M chr8 | SEQ ID NO:1101 |
| >SNP8NRG1254664_allelePos=201 total len = 401 SNP=R chr8 | SEQ ID NO:1102 |
| >SNP8NRG1255046_allelePos=201 total len = 401 SNP=R chr8 | SEQ ID NO:1103 |

TABLE 2-continued

Microsatellites, SNP's, and insertions/deletions in the 1.5 Mb sequence.

| | |
|---|---|
| >SNP8NRG1255125__allelePos=201 total len = 401 SNP=W chr8 | SEQ ID NO:1104 |
| >SNP8NRG1255741__allelePos=201 total len = 401 SNP=R chr8 | SEQ ID NO:1105 |
| >SNP8NRG1255914__allelePos=201 total len = 401 SNP=S chr8 | SEQ ID NO:1106 |
| >SNP8NRG1255957__allelePos=201 total len = 401 SNP=W chr8 | SEQ ID NO:1107 |
| >SNP8NRG1256067__allelePos=201 total len = 401 SNP=W chr8 | SEQ ID NO:1108 |
| >SNP8NRG1256662__allelePos=201 total len = 401 SNP=Y chr8 | SEQ ID NO:1109 |
| >SNP8NRG1257547__allelePos=201 total len = 401 SNP=W chr8 | SEQ ID NO:1110 |
| >SNP8NRG1257630__allelePos=201 total len = 401 SNP=R chr8 | SEQ ID NO:1111 |
| >SNP8NRG1258199__allelePos=201 total len = 401 SNP=Y chr8 | SEQ ID NO:1112 |
| >SNP8NRG1259875__allelePos=201 total len = 401 SNP=R chr8 | SEQ ID NO:1113 |
| >SNP8NRG1259962__allelePos=201 total len = 401 SNP=R chr8 | SEQ ID NO:1114 |
| >SNP8NRG1260209__allelePos=201 total len = 401 SNP=Y chr8 | SEQ ID NO:1115 |
| >SNP8NRG1262000__allelePos=201 total len = 401 SNP=R chr8 | SEQ ID NO:1116 |
| >SNP8NRG1263565__allelePos=201 total len = 401 SNP=K chr8 | SEQ ID NO:1117 |
| >SNP8NRG1264984__allelePos=201 total len = 401 SNP=S chr8 | SEQ ID NO:1118 |
| >SNP8NRG1265298__allelePos=201 total len = 401 SNP=M chr8 | SEQ ID NO:1119 |
| >SNP8NRG1265868__allelePos=201 total len = 401 SNP=R chr8 | SEQ ID NO:1120 |
| >SNP8NRG1266163__allelePos=201 total len = 401 SNP=Y chr8 | SEQ ID NO:1121 |
| >SNP8NRG1266815__allelePos=201 total len = 401 SNP=M chr8 | SEQ ID NO:1122 |
| >SNP8NRG1266842__allelePos=201 total len = 401 SNP=R chr8 | SEQ ID NO:1123 |
| >SNP8NRG1267431__allelePos=201 total len = 401 SNP=Y chr8 | SEQ ID NO:1124 |
| >SNP8NRG1267974__allelePos=201 total len = 401 SNP=R chr8 | SEQ ID NO:1125 |
| >SNP8NRG1268435__allelePos=201 total len = 401 SNP=W chr8 | SEQ ID NO:1126 |
| >SNP8NRG1268860__allelePos=201 total len = 401 SNP=W chr8 | SEQ ID NO:1127 |
| >SNP8NRG1269159__allelePos=201 total len = 401 SNP=Y chr8 | SEQ ID NO:1128 |
| >SNP8NRG1270128__allelePos=201 total len = 401 SNP=K chr8 | SEQ ID NO:1129 |
| >SNP8NRG1271589__allelePos=201 total len = 401 SNP=K chr8 | SEQ ID NO:1130 |
| >SNP8NRG1272260__allelePos=201 total len = 401 SNP=R chr8 | SEQ ID NO:1131 |
| >SNP8NRG1272304__allelePos=201 total len = 401 SNP=R chr8 | SEQ ID NO:1132 |
| >SNP8NRG1272374__allelePos=201 total len = 401 SNP=W chr8 | SEQ ID NO:1133 |
| >SNP8NRG1272464__allelePos=201 total len = 401 SNP=W chr8 | SEQ ID NO:1134 |
| >SNP8NRG1272543__allelePos=201 total len = 401 SNP=M chr8 | SEQ ID NO:1135 |
| >SNP8NRG1272668__allelePos=201 total len = 401 SNP=R chr8 | SEQ ID NO:1136 |
| >SNP8NRG1272888__allelePos=201 total len = 401 SNP=R chr8 | SEQ ID NO:1137 |
| >SNP8NRG1273061__allelePos=201 total len = 401 SNP=S chr8 | SEQ ID NO:1138 |
| >SNP8NRG1273077__allelePos=201 total len = 401 SNP=Y chr8 | SEQ ID NO:1139 |
| >SNP8NRG1273166__allelePos=201 total len = 401 SNP=R chr8 | SEQ ID NO:1140 |
| >SNP8NRG1273740__allelePos=201 total len = 401 SNP=W chr8 | SEQ ID NO:1141 |
| >SNP8NRG1273827__allelePos=201 total len = 401 SNP=R chr8 | SEQ ID NO:1142 |
| >SNP8NRG1274180__allelePos=201 total len = 401 SNP=S chr8 | SEQ ID NO:1143 |
| >SNP8NRG1274457__allelePos=201 total len = 401 SNP=M chr8 | SEQ ID NO:1144 |
| >SNP8NRG1274783__allelePos=201 total len = 401 SNP=R chr8 | SEQ ID NO:1145 |
| >SNP8NRG1274969__allelePos=201 total len = 401 SNP=K chr8 | SEQ ID NO:1146 |
| >SNP8NRG1275610__allelePos=201 total len = 401 SNP=Y chr8 | SEQ ID NO:1147 |
| >SNP8NRG1275799__allelePos=201 total len = 401 SNP=R chr8 | SEQ ID NO:1148 |
| >SNP8NRG1276037__allelePos=201 total len = 401 SNP=R chr8 | SEQ ID NO:1149 |
| >SNP8NRG1276414__allelePos=201 total len = 401 SNP=R chr8 | SEQ ID NO:1150 |
| >SNP8NRG1276446__allelePos=201 total len = 401 SNP=R chr8 | SEQ ID NO:1151 |
| >SNP8NRG1276637__allelePos=201 total len = 401 SNP=S chr8 | SEQ ID NO:1152 |
| >SNP8NRG1277059__allelePos=201 total len = 401 SNP=K chr8 | SEQ ID NO:1153 |
| >SNP8NRG1277472__allelePos=201 total len = 401 SNP=M chr8 | SEQ ID NO:1154 |
| >SNP8NRG1278314__allelePos=201 total len = 401 SNP=R chr8 | SEQ ID NO:1155 |
| >SNP8NRG1278795__allelePos=201 total len = 401 SNR=R chr8 | SEQ ID NO:1156 |
| >SNP8NRG1278988__allelePos=201 total len = 401 SNP=Y chr8 | SEQ ID NO:1157 |
| >SNP8NRG1279521__allelePos=201 total len = 401 SNP=S chr8 | SEQ ID NO:1158 |
| >SNP8NRG1280302__allelePos=201 total len = 401 SNP=R chr8 | SEQ ID NO:1159 |
| >SNP8NRG1280674__allelePos=201 total len = 401 SNP=Y chr8 | SEQ ID NO:1160 |
| >SNP8NRG1281150__allelePos=201 total len = 401 SNP=R chr8 | SEQ ID NO:1161 |
| >SNP8NRG1282634__allelePos=201 total len = 401 SNP=R chr8 | SEQ ID NO:1162 |
| >SNP8NRG1282925__allelePos=201 total len = 401 SNP=R chr8 | SEQ ID NO:1163 |
| >SNP8NRG1283083__allelePos=201 total len = 401 SNP=R chr8 | SEQ ID NO:1164 |
| >SNP8NRG1285544__allelePos=201 total len = 401 SNP=R chr8 | SEQ ID NO:1165 |
| >SNP8NRG1285783__allelePos=201 total len = 401 SNP=W chr8 | SEQ ID NO:1166 |
| >SNP8NRG1286299__allelePos=201 total len = 401 SNP=M chr8 | SEQ ID NO:1167 |
| >SNP8NRG1286599__allelePos=201 total len = 401 SNP=M chr8 | SEQ ID NO:1168 |
| >SNP8NRG1286701__allelePos=201 total len = 401 SNP=M chr8 | SEQ TD N0 1169 |
| >SNP8NRG1288413__allelePos=201 total len = 401 SNP=R chr8 | SEQ ID NO:1170 |
| >SNP8NRG1290436__allelePos=201 total len = 401 SNP=Y chr8 | SEQ ID NO:1171 |
| >SNP8NRG1290470__allelePos=201 total len = 401 SNP=M chr8 | SEQ ID NO:1172 |
| >SNP8NRG1290477__allelePos=201 total len = 401 SNP=Y chr8 | SEQ ID NO:1173 |
| >SNP8NRG1291862__allelePos=201 total len = 401 SNP=S chr8 | SEQ ID NO:1174 |
| >SNP8NRG1294980__allelePos=201 total len = 401 SNP=R chr8 | SEQ ID NO:1175 |
| >SNP8NRG1295146__allelePos=201 total len = 401 SNP=S chr8 | SEQ ID NO:1176 |
| >SNP8NRG1295606__allelePos=201 total len = 401 SNP=Y chr8 | SEQ ID NO:1177 |
| >SNP8NRG1298104__allelePos=201 total len = 401 SNP=R chr8 | SEQ ID NO:1178 |
| >SNP8NRG1298536__allelePos=201 total len = 401 SNP=Y chr8 | SEQ ID NO:1179 |
| >SNP8NRG1299696__allelePos=201 total len = 401 SNP=Y chr8 | SEQ ID NO:1180 |

TABLE 2-continued

Microsatellites, SNP's, and insertions/deletions in the 1.5 Mb sequence.

| | |
|---|---|
| >SNP8NRG1300226__allelePos=201 total len = 401 SNP=S chr8 | SEQ ID NO:1181 |
| >SNP8NRG1300286__allelePos=201 total len = 401 SNP=K chr8 | SEQ ID NO:1182 |
| >SNP8NRG130127S__allelePos=201 total len = 401 SNP=K chr8 | SEQ ID NO:1183 |
| >SNP8NRG1301666__allelePos=201 total len = 401 SNP=W chr8 | SEQ ID NO:1184 |
| >SNP8NRG1301678__allelePos=201 total len = 401 SNP=Y chr8 | SEQ ID NO:1185 |
| >SNP8NRG1301762__allelePos=201 total len = 401 SNP=Y chr8 | SEQ ID NO:1186 |
| >SNP8NRG1301912__allelePos=201 total len = 401 SNP=Y chr8 | SEQ ID NO:1187 |
| >SNP8NRG1302463__allelePos=201 total len = 401 SNP=W chr8 | SEQ ID NO:1188 |
| >SNP8NRG1302705__allelePos=201 total len = 401 SNP=S chr8 | SEQ ID NO:1189 |
| >SNP8NRG1303192__allelePos=201 total len = 401 SNP=M chr8 | SEQ ID NO:1190 |
| >SNP8NRG1304742__allelePos=201 total len = 401 SNP=Y chr8 | SEQ ID NO:1191 |
| >SNP8NRG1305338__allelePos=201 total len = 401 SNP=Y chr8 | SEQ ID NO:1192 |
| >SNP8NRG1307133__allelePos=201 total len = 401 SNP=K chr8 | SEQ ID NO:1193 |
| >SNP8NRG1307451__allelePos=201 total len = 401 SNP=R chr8 | SEQ ID NO:1194 |
| >SNP8NRG1307639__allelePos=201 total len = 401 SNP=W chr8 | SEQ ID NO:1195 |
| >SNP8NRG1308273__allelePos=201 total len = 401 SNP=R chr8 | SEQ ID NO:1196 |
| >SNP8NRG1308395__allelePos=201 total len = 401 SNP=W chr8 | SEQ ID NO:1197 |
| >SNP8NRG1308400__allelePos=201 total len = 401 SNP=Y chr8 | SEQ ID NO:1198 |
| >SNP8NRG1308418__allelePos=201 total len = 401 SNP=R chr8 | SEQ ID NO:1199 |
| >SNP8NRG1308442__allelePos=201 total len = 401 SNP=Y chr8 | SEQ ID NO:1200 |
| >SNP8NRG1308461__allelePos=201 total len = 401 SNP=K chr8 | SEQ ID NO:1201 |
| >SNP8NRG1308468__allelePos=201 total len = 401 SNP=R chr8 | SEQ ID NO:1202 |
| >SNP8NRG1308493__allelePos=201 total len = 401 SNP=R chr8 | SEQ ID NO:1203 |
| >SNP8NRG1308501__allelePos=201 total len = 401 SNP=R chr8 | SEQ ID NO:1204 |
| >SNP8NRG1308514__allelePos=201 total len = 401 SNP=R chr8 | SEQ ID NO:1205 |
| >SNP8NRG1309256__allelePos=201 total len = 401 SNP=W chr8 | SEQ ID NO:1206 |
| >SNP8NRG1309951__allelePos=201 total len = 401 SNP=Y chr8 | SEQ ID NO:1207 |
| >SNP8NRG1310295__allelePos=201 total len = 401 SNP=M chr8 | SEQ ID NO:1208 |
| >SNP8NRG1311432__allelePos=201 total len = 401 SNP=R chr8 | SEQ ID NO:1209 |
| >SNP8NRG1311607__allelePos=201 total len = 401 SNP=M chr8 | SEQ ID NO:1210 |
| >SNP8NRG1311887__allelePos=201 total len = 401 SNP=M chr8 | SEQ ID NO:1211 |
| >SNP8NRG1314245__allelePos=201 total len = 401 SNP=R chr8 | SEQ ID NO:1212 |
| >SNP8NRG1314574__allelePos=201 total len = 401 SNP=M chr8 | SEQ ID NO:1213 |
| >SNP8NRG1315474__allelePos=201 total len = 401 SNP=R chr8 | SEQ ID NO:1214 |
| >SNP8NRG1317178__allelePos=201 total len = 401 SNP=R chr8 | SEQ ID NO:1215 |
| >SNP8NRG1317711__allelePos=201 total len = 401 SNP=Y chr8 | SEQ ID NO:1216 |
| >SNP8NRG1318681__allelePos=201 total len = 401 SNP=R chr8 | SEQ ID NO:1217 |
| >SNP8NRG1318959__allelePos=201 total len = 401 SNP=Y chr8 | SEQ ID NO:1218 |
| >SNP8NRG1319332__allelePos=201 total len = 401 SNP=M chr8 | SEQ ID NO:1219 |
| >SNP8NRG1319542__allelePos=201 total len = 401 SNP=R chr8 | SEQ ID NO:1220 |
| >SNP8NRG1320206__allelePos=201 total len = 401 SNP=M chr8 | SEQ ID NO:1221 |
| >SNP8NRG1320216__allelePos=201 total len = 401 SNP=Y chr8 | SEQ ID NO:1222 |
| >SNP8NRG1320493__allelePos=201 total len = 401 SNP=M chr8 | SEQ ID NO:1223 |
| >SNP8NRG1320889__allelePos=201 total len = 401 SNP=Y chr8 | SEQ ID NO:1224 |
| >SNP8NRG1320895__allelePos=201 total len = 401 SNP=Y chr8 | SEQ ID NO:1225 |
| >SNP8NRG1321251__allelePos=201 total len = 401 SNP=R chr8 | SEQ ID NO:1226 |
| >SNP8NRG1321508__allelePos=201 total len = 401 SNP=R chr8 | SEQ ID NO:1227 |
| >SNP8NRG1321634__allelePos=201 total len = 401 SNP=W chr8 | SEQ ID NO:1228 |
| >SNP8NRG1321737__allelePos=201 total len = 401 SNP=Y chr8 | SEQ ID NO:1229 |
| >SNP8NRG1322161__allelePos=201 total len = 401 SNP=R chr8 | SEQ ID NO:1230 |
| >SNP8NRG1324356__allelePos=201 total len = 401 SNP=R chr8 | SEQ ID NO:1231 |
| >SNP8NRG1324963__allelePos=201 total len = 401 SNP=Y chr8 | SEQ ID NO:1232 |
| >SNP8NRG1325396__allelePos=201 total len = 401 SNP=R chr8 | SEQ ID NO:1233 |
| >SNP8NRG1326212__allelePos=201 total len = 401 SNP=Y chr8 | SEQ ID NO:1234 |
| >SNP8NRG1326510__allelePos=201 total len = 401 SNP=R chr8 | SEQ ID NO:1235 |
| >SNP8NRG1327154__allelePos=201 total len = 401 SNP=M chr8 | SEQ ID NO:1236 |
| >SNP8NRG1327266__allelePos=201 total len = 401 SNP=Y chr8 | SEQ ID NO:1237 |
| >SNP8NRG1328880__allelePos=201 total len = 401 SNP=K chr8 | SEQ ID NO:1238 |
| >SNP8NRG1330525__allelePos=201 total len = 401 SNP=R chr8 | SEQ ID NO:1239 |
| >SNP8NRG1330554__allelePos=201 total len = 401 SNP=S chr8 | SEQ ID NO:1240 |
| >SNP8NRG1330689__allelePos=201 total len = 401 SNP=R chr8 | SEQ ID NO:1241 |
| >SNP8NRG1331283__allelePos=201 total len = 401 SNP=Y chr8 | SEQ ID NO:1242 |
| >SNP8NRG1332146__allelePos=201 total len = 401 SNP=R chr8 | SEQ ID NO:1243 |
| >SNP8NRG1333911__allelePos=201 total len = 401 SNP=Y chr8 | SEQ ID NO:1244 |
| >SNP8NRG1334849__allelePos=201 total len = 401 SNP=R chr8 | SEQ ID NO:1245 |
| >SNP8NRG1335876__allelePos=201 total len = 401 SNP=W chr8 | SEQ ID NO:1246 |
| >SNP8NRG1336199__aIlelePos=201 total len = 401 SNP=S chr8 | SEQ ID NO:1247 |
| >SNP8NRG1336412__allelePos=201 total len = 401 SNP=Y chr8 | SEQ ID NO:1248 |
| >SNP8NRG1336584__allelePos=201 total len = 401 SNP=R chr8 | SEQ ID NO:1249 |
| >SNP8NRG1337276__allelePos=201 total len = 401 SNP=M chr8 | SEQ ID NO:1250 |
| >SNP8NRG1337281__allelePos=201 total len = 401 SNP=W chr8 | SEQ ID NO:1251 |
| >SNP8NRG1337854__allelePos=201 total len = 401 SNP=R chr8 | SEQ ID NO:1252 |
| >SNP8NRG1338477__allelePos=201 total len = 401 SNP=R chr8 | SEQ ID NO:1253 |
| >SNP8NRG1341468__allelePos=201 total len = 401 SNP=R chr8 | SEQ ID NO:1254 |
| >SNP8NRG1341762__allelePos=201 total len = 401 SNP=R chr8 | SEQ ID NO:1255 |
| >SNP8NRG1343290__allelePos=201 total len = 401 SNP=R chr8 | SEQ ID NO:1256 |
| >SNP8NRG1346901__allelePos=201 total len = 401 SNP=Y chr8 | SEQ ID NO:1257 |

TABLE 2-continued

Microsatellites, SNP's, and insertions/deletions in the 1.5 Mb sequence.

| | | |
|---|---|---|
| >SNP8NRG1350636__allelePos=201 total len = 401 SNP=R chr8 | | SEQ ID NO:1258 |
| >SNP8NRG1350705__allelePos=201 total len = 401 SNP=S chr8 | | SEQ ID NO:1259 |
| >SNP8NRG1350738__allelePos=201 total len = 401 SNP=R chr8 | | SEQ ID NO:1260 |
| >SNP8NRG1352895__allelePos=201 total len = 401 SNP=R chr8 | | SEQ ID NO:1261 |
| >SNP8NRG1352946__allelePos=201 total len = 401 SNP=Y chr8 | | SEQ ID NO:1262 |
| >SNP8NRG1354585__allelePos=201 total len = 401 SNP=W chr8 | | SEQ ID NO:1263 |
| >SNP8NRG1356043__allelePos=201 total len = 401 SNP=M chr8 | | SEQ ID NO:1264 |
| >SNP8NRG1357410__allelePos=201 total len = 401 SNP=R chr8 | | SEQ ID NO:1265 |
| >SNP8NRG1357630__allelePos=201 total len = 401 SNP=M chr8 | | SEQ ID NO:1266 |
| >SNP8NRG1357743__allelePos=201 total len = 401 SNP=W chr8 | | SEQ ID NO:1267 |
| >SNP8NRG1357786__allelePos=201 total len = 401 SNP=K chr8 | | SEQ ID NO:1268 |
| >SNP8NRG1357874__allelePos=201 total len = 401 SNP=K chr8 | | SEQ ID NO:1269 |
| >SNP8NRG1358798__allelePos=201 total len = 401 SNP=S chr8 | | SEQ ID NO:1270 |
| >SNP8NRG1359095__allelePos=201 total len = 401 SNP=W chr8 | | SEQ ID NO:1271 |
| >SNP8NRG1359576__allelePos=201 total len = 401 SNP=R chr8 | | SEQ ID NO:1272 |
| >SNP8NRG1473356__allelePos=201 total len = 401 SNP=R chr8 | | SEQ ID NO:1273 |
| >SNP8NRG1473576__allelePos=201 total len = 401 SNP=S chr8 | | SEQ ID NO:1274 |
| >SNP8NRG1473605__allelePos=201 total len = 401 SNP=S chr8 | | SEQ ID NO:1275 |
| >SNP8NRG1473982__allelePos=201 total len = 401 SNP=K chr8 | | SEQ ID NO:1276 |
| >SNP8NRG1473988__allelePos=201 total len = 401 SNP=K chr8 | | SEQ ID NO:1277 |
| >SNP8NRG1474075__allelePos=201 total len = 401 SNP=Y chr8 | | SEQ ID NO:1278 |
| >SNP8NRG1476474__allelePos=201 total len = 401 SNP=Y chr8 | | SEQ ID NO:1279 |
| >SNP8NRG1476769__allelePos=201 total len = 401 SNP=R chr8 | | SEQ ID NO:1280 |
| >SNP8NRG1476774__allelePos=201 total len = 401 SNP=R chr8 | | SEQ ID NO:1281 |
| >SNP8NRG1477042__allelePos=201 total len = 401 SNP=K chr8 | | SEQ ID NO:1282 |
| >SNP8NRG1477118__allelePos=201 total len = 401 SNP=K chr8 | | SEQ ID NO:1283 |
| >SNP8NRGd131E1006 allelePos=31 total len = 60 SNP=r chr8 | (245747-245807) | SEQ ID NO:1284 |
| >SNP8NRGd222E1006 allelePos=31 total len = 60 SNP=r chr8 | (245838-245898) | SEQ ID NO:1285 |
| >SNP8NRGd279E1006 allelePos=31 total len = 60 SNP=r chr8 | (245895-245955) | SEQ ID NO:1286 |
| >SNP8NRGd606E1006 allelePos=31 total len = 60 SNP=k chr8 | (246222-246282) | SEQ ID NO:1287 |
| >SNP8NRGu86SE92 allelePos=31 total len 60 SNP=k chr8 | (825115-825173) | SEQ ID NO:1288 |
| >SNP8NRGu3E46 allelePos=31 total len = 60 SNP=k chr8 | (826277-8263 36) | SEQ ID NO:1289 |
| >SNP8NRGd68E46 allelePos=31 total len = 60 SNP=r chr8 | (826393-826453) | SEQ ID NO:1290 |
| >SNP8NRGd198E46 allelePos=31 total len 60 SNP=y chr8 | (826523-826583) | SEQ ID NO:1291 |
| >SNP8NRG991707 allelePos=31 total len = 60 SNP=y chr8 | (994608-994668) | SEQ ID NO:1292 |
| >SNP8NRG1098566 allelePos=31 total len 60 SNP=k chr8 | (1101477-1101537) | SEQ ID NO:1293 |
| >SNP8NRG1098567 allelePos=32 total len 60 SNP=y chr8 | (1101477-1101537) | SEQ ID NO:1294 |
| >SNP8NRG1098745 allelePos=29 total len = 60 SNP=k chr8 | (1101653-1101713) | SEQ ID NO:1295 |
| >SNP8NRG1098765 allelePos=31 total len = 60 SNP=y chr8 | (1101671-1101731) | SEQ ID NO:1296 |
| >SNP8NRGu28E592 allelePos=30 total len = 60 SNP=r chr8 | (1153236-1153296) | SEQ ID NO:1297 |
| >SNP8NRGu29E592 allelePos=31 total len = 60 SNP=r chr8 | (1153236-1153296) | SEQ ID NO:1298 |
| >SNP8NRGu30E592 allelePos=32 total len 60 SNP=r chr8 | (1153236-1153296) | SEQ ID NO:1299 |
| >SNP8NRGd38E592 allelePos=31 total len = 60 SNP=y chr8 | (1153894-1153954) | SEQ ID NO:1300 |
| >SNP8NRGd103E592 allelePos=31 total len = 60 SNP=s chr8 | (1153959-1154019) | SEQ ID NO:1301 |
| >SNP8NRGd162E592 allelePos=31 total len = 60 SNP=s chr8 | (1154018-1154078) | SEQ ID NO:1302 |
| >SNP8NRGd20SE592 allelePos=31 total len = 60 SNP=r chr8 | (1154061-1154122) | SEQ ID NO:1303 |
| >SNP8NRGd258E592 allelePos=30 total len 60 SNP=y chr8 | (1154115-1154174) | SEQ ID NO:1304 |
| >SNP8NRGu111ES16 allelePos=33 total len = 60 SNP=y chr8 | (1221721-1221784) | SEQ ID NO:1305 |
| >SNP8NRGu77E290 allelePos=31 total len 60 SNP=k chr8 | (1326675-1326735) | SEQ ID NO:1306 |
| >SNP8NRGd86E290 allelePos=31 total len 60 SNP=y chr8 | (1327127-1327187) | SEQ ID NO:1307 |
| >SNP8NRGd126E290 allelePos=31 total len = 60 SNP=s chr8 | (1327167-1327227) | SEQ ID NO:1308 |
| >SNP8NRGu13SE131 allelePos=31 total len= 60 SNP=r chr8 | (1364198-1364258) | SEQ ID NO:1309 |
| >SNP8Ad1163E1006 allelePos=31 total len = 60 SNP=y chr8 | (246779-246839) | SEQ ID NO:1310 |
| >SNP8NRGu5E207 allelePos=31 total len = 60 SNP=y chr8 | (1365222-1365285) | SEQ ID NO:1311 |
| >SNP8NRG1AGu48E38 allelePos=31 total len = 60 SNP=r chr8 | (631205-631265) | SEQ ID NO:1312 |
| >SNP8NRG1AGu45E38 allelePos=31 total len = 60 SNP=s chr8 | (631208-631268) | SEQ ID NO:1313 |
| >SNP8NRG1AGd148E262 allelePos=3l total len = 60 SNP=w chr8 | (744556-7446 16) | SEQ ID NO:1314 |
| >SNP8NRG21339 allelePos=31 total len 60 SNP=M chr8 | | SEQ ID NO:1315 |
| >SNP8NRG106058 allelePos=31 total len 60 SNP=R chr8 | | SEQ ID NO:1316 |
| >SNP8NRG107L56 allelePos=31 total len = 60 SNP=R chr8 | | SEQ ID NO:1317 |
| >SNP8NRG110796 allelePos=31 total len = 60 SNP=K chr8 | | SEQ ID NO:1318 |
| >SNP8NRG130911 allelePos=31 total len = 60 SNP=R chr8 | | SEQ ID NO:1319 |
| >SNP8NRG138389 allelePos=31 total len = 60 SNP=Y chr8 | | SEQ ID NO:1320 |
| >SNP8NRG156534 allelePos=31 total len = 60 SNP=R chr8 | | SEQ ID NO:1321 |
| >SNP8NRG156840 allelePos=31 total len = 60 SNP=Y chr8 | | SEQ ID NO:1322 |
| >SNP8NRG224932 allelePos=31 total len = 60 SNP=R chr8 | | SEQ ID NO:1323 |
| >SNP8NRG225178 allelePos=31 total len = 60 SNP=R chr8 | | SEQ ID NO:1324 |
| >SNP8NRG225182 allelePos=35 total len = 60 SNP=Y chr8 | | SEQ ID NO:1325 |
| >SNP8NRG226107 allelePos=31 total len = 60 SNP=Y chr8 | | SEQ ID NO:1326 |
| >SNP8NRG226372 allelePos=31 total len = 60 SNP=Y chr8 | | SEQ ID NO:1327 |
| >SNP8NRG228755 allelePos=31 total len = 60 SNP=Y chr8 | | SEQ ID NO:1328 |
| >SNP8NRG229765 allelePos=31 total len = 60 SNP=Y chr8 | | SEQ ID NO:1329 |
| >SNP8NRG229820 a1lelePos=31 total len = 60 SNP=Y chr8 | | SEQ ID NO:1330 |
| >SNP8NRG230727 allelePos=31 total len = 60 SNP=K chr8 | | SEQ ID NO:1331 |
| >SNP8NRG232445 allelePos=31 total len = 60 SNP=Y chr8 | | SEQ ID NO:1332 |
| >SNP8NRG345545 allelePos=31 total len = 60 SNP=R chr8 | | SEQ ID NO:1333 |
| >SNP8NRG380850 allelePos=31 total len = 60 SNP=K chr8 | | SEQ ID NO:1334 |

TABLE 2-continued

Microsatellites, SNP's, and insertions/deletions in the 1.5 Mb sequence.

| | | |
|---|---|---|
| >SNP8NRG381288 allelePos=31 total len = 60 SNP=K chr8 | | SEQ ID NO:1335 |
| >SNP8NRG381409 allelePos=31 total len = 60 SNP=R chr8 | | SEQ ID NO:1336 |
| >SNP8NRG383073 allelePos=31 total len = 60 SNP=W chr8 | | SEQ ID NO:1337 |
| >SNP8NRG391764 allelePos=31 total len = 60 SNP=Y chr8 | | SEQ ID NO:1338 |
| >SNP8NRG393090 allelePos=31 total len = 60 SNP=Y chr8 | | SEQ ID NO:1339 |
| >SNP8NRG397703 allelePos=31 total len = 60 SNP=M chr8 | | SEQ ID NO:1340 |
| >SNP8NRG686849 allelePos=31 total len = 60 SNP=R chr8 | | SEQ ID NO:1341 |
| >SNP8NRG690807 allelePos=31 total len = 60 SNP=R chr8 | | SEQ ID NO:1342 |
| >SNP8NRG696489 allelePos=31 total len = 60 SNP=M chr8 | | SEQ ID NO:1343 |
| >SNP8NRG701248 allelePos=31 total len = 60 SNP=M chr8 | | SEQ ID NO:1344 |
| >SNP8NRG701526 allelePos=31 total len = 60 SNP=M chr8 | | SEQ ID NO:1345 |
| >SNP8NRG701944 allelePos=31 total len = 60 SNP=S chr8 | | SEQ ID NO:1346 |
| >SNP8NRG712601 allelePos=31 total len = 60 SNP=Y chr8 | | SEQ ID NO:1347 |
| >SNP8NRG727336 allelePos=31 total len = 60 SNP=S chr8 | | SEQ ID NO:1348 |
| >SNP8NRG807447 allelePos=31 total len = 60 SNP=R chr8 | | SEQ ID NO:1349 |
| >SNP8NRG809147 allelePos=31 total len = 60 SNP=K chr8 | | SEQ ID NO:1350 |
| >SNP8NRG809290 allelePos=31 total len = 60 SNP=Y chr8 | | SEQ ID NO:1351 |
| >SNP8NRG810522 allelePos=31 total len = 60 SNP=K chr8 | | SEQ ID NO:1352 |
| >SNP8NRG814838 allelePos=31 total len = 60 SNP=W chr8 | | SEQ ID NO:1353 |
| >SNP8NRG818760 allelePos=31 total len = 60 SNP=R chr8 | | SEQ ID NO:1354 |
| >SNP8NRG819991 allelePos=31 total len = 60 SNP=K chr8 | | SEQ ID NO:1355 |
| >SNP8NRG834637 allelePos=31 total len = 60 SNP=Y chr8 | | SEQ ID NO:1356 |
| >SNP8NRG840S60 allelePos=31 total len = 60 SNP=Y chr8 | | SEQ ID NO:1357 |
| >SNP8NRG1047074 allelePos=31 total len = 60 SNP=S chr8 | | SEQ ID NO:1358 |
| >SNP8NRG1076729 allelePos=31 total len = 60 SNP=K chr8 | | SEQ ID NO:1359 |
| >SNP8NRG1083409 allelePos=28 total len 53 SNP=R chr8 | | SEQ ID NO:1360 |
| >SNP8NRG1089867 allelePos=31 total len 60 SNP=Y chr8 | | SEQ ID NO:1361 |
| >SNP8NRG1098094 allelePos=30 total len 60 SNP=S chr8 | | SEQ ID NO:1362 |
| >SNP8NRG1103650 allelePos=27 total len 60 SNP=R chr8 | | SEQ ID NO:1363 |
| >SNP8NRG1111202 allelePos=31 total len = 60 SNP=K chr8 | | SEQ ID NO:1364 |
| >SNP8NRG1283935 allelePos=32 total len 60 SNP=K chr8 | | SEQ ID NO:1365 |
| >SNP8NRG257738 allelePos=53 total len = 89 SNP=Y chr8 | | SEQ ID NO:1366 |
| >SNP8NRGu42E127__AP301__Len558__chr8 SNP=R | (1361122-1361679) | SEQ ID NO:1367 |
| >SNP8NRGu27E127__AP316__Len558__chr8 SNP | (1361122-1361679) | SEQ ID NO:1368 |
| >SNP8NRGu86SE92__AP263__Len554__chr8 SNP=K | (824883-825436) | SEQ ID NO:1369 |
| >SNP8NRG220954__AP201__LEN401__chr8 SNP=Y | | SEQ ID NO:1370 |
| >SNP8NRG221067__AP201__LEN401__chr8 SNP=Y | | SEQ ID NO:1371 |
| >SNP8NRG22I132__AP201__LEN401__chr8 SNP=R | | SEQ ID NO:1372 |
| >SNP8NRG221533__AP201__LEN401__chr8 SNP=Y | | SEQ ID NO:1373 |
| >SNP8NRG221589__AP201__LEN401__chr8 SNP=Y | | SEQ ID NO:1374 |
| v) Insertions/deletions in the 1.5 Mb sequence: | | |
| >SNP8NRG8S307del25 | (84970-85394) | SEQ ID NO:1375 |
| >SNP8NRGd120E131 | (1364356-1364755) | SEQ ID NO:1376 |
| >SNP8NRGde1314 | (1107324-1107723) | SEQ ID NO:1377 |
| >DNP8NRG1 | (6759-7159) | SEQ ID NO:1378 |
| >DNP8NRG2 | (6775-7178) | SEQ ID NO:1379 |
| >DNP8NRG3 | (6855-7255) | SEQ ID NO:1380 |
| >DNP8NRG4 | (9329-9733) | SEQ ID NO:1381 |
| >DNP8NRG5 | (36908-37303) | SEQ ID NO:1382 |
| >DNP8NRG6 | (36925-37320) | SEQ ID NO:1383 |
| >DNP8NRG7 | (36936-37331) | SEQ ID NO:1384 |
| >DNP8NRG8 | (36948-37343) | SEQ ID NO:1385 |
| >DNP8NRG9 | (36952-37344) | SEQ ID NO:1386 |
| >DNP8NRG10 | (37941-38350) | SEQ ID NO:1387 |
| >DNP8NRG11 | (41138-41537) | SEQ ID NO:1388 |
| >DNP8NRG12 | (45993-46442) | SEQ ID NO:1389 |
| >DNP8NRG13 | (62105-62516) | SEQ ID NO:1390 |
| >DNP8NRG14 | (69092-69491) | SEQ ID NO:1391 |
| >DNP8NRG15 | (71515-71918) | SEQ ID NO:1392 |
| >DNP8NRG16 | (86127-86527) | SEQ ID NO:1393 |
| >DNP8NRG17 | (90190-90590) | SEQ ID NO:1394 |
| >DNP8NRG18 | (93184-93587) | SEQ ID NO:1395 |
| >DNP8NRG19 | (99076-99501) | SEQ ID NO:1396 |
| >DNP8NRG20 | (102514-102917) | SEQ ID NO:1397 |
| >DNP8NRG21 | (107441-107841) | SEQ ID NO:1398 |
| >DNP8NRG22 | (109137-109541) | SEQ ID NO:1399 |
| >DNP8NRG23 | (109636-110040) | SEQ ID NO:1400 |
| >DNP8NRG24 | (111743-112118) | SEQ ID NO:1401 |
| >DNP8NRG25 | (127196-127609) | SEQ ID NO:1402 |
| >DNP8NRG26 | (134509-134908) | SEQ ID NO:1403 |
| >DNP8NRG27 | (135198-135602) | SEQ ID NO:1404 |
| >DNP8NRG28 | (136821-152899) | SEQ ID NO:1405 |
| >DNP8NRG29 | (168772-169175) | SEQ ID NO:1406 |
| >DNP8NRG30 | (232615-233018) | SEQ ID NO:1407 |
| >DNP8NRG31 | (237553-237958) | SEQ ID NO:1408 |
| >DNP8NRG32 | (375355-375754) | SEQ ID NO:1409 |

TABLE 2-continued

Microsatellites, SNP's, and insertions/deletions in the 1.5 Mb sequence.

| | | |
|---|---|---|
| >DNP8NRG33 | (375514-375917) | SEQ ID NO:1410 |
| >DNP8NRG34 | (401168-401570) | SEQ ID NO:1411 |
| >DNP8NRG35 | (428883-429290) | SEQ ID NO:1412 |
| >DNP8NRG36 | (447398-447801) | SEQ ID NO:1413 |
| >DNP8NRG37 | (480801-481205) | SEQ ID NO:1414 |
| >DNP8NRG38 | (529910-530309) | SEQ ID NO:1415 |
| >DNP8NRG39 | (548278-548677) | SEQ ID NO:1416 |
| >DNP8NRG40ca4 | (551356-551755) | SEQ ID NO:1417 |
| >DNP8NRG41 | (552710-553112) | SEQ ID NO:1418 |
| >DNP8NRG42 | (562788-563199) | SEQ ID NO:1419 |
| >DNP8NRG43 | (564544-564942) | SEQ ID NO:1420 |
| >DNP8NRG44 | (564584-564987) | SEQ ID NO:1421 |
| >DNP8NRG45 | (592084-592487) | SEQ ID NO:1422 |
| >DNP8NRG46 | (594011-594419) | SEQ ID NO:1423 |
| >DNP8NRG47 | (596069-596536) | SEQ ID NO:1424 |
| >DNP8NRG48 | (599427-599827) | SEQ ID NO:1425 |
| >DNP8NRG49 | (680422-680847) | SEQ ID NO:1426 |
| >DNP8NRG50 | (685526-685929) | SEQ ID NO:1427 |
| >DNP8NRG51 | (686532-686956) | SEQ ID NO:1428 |
| >DNP8NRG52 | (692241-692640) | SEQ ID NO:1429 |
| >DNP8NRG53__AAGAGGGCCTG__replaced | (702892-703303) | SEQ ID NO:1430 |
| >DNP8NRG54 | (711819-712221) | SEQ ID NO:1431 |
| >DNP8NRG55 | (711992-712392) | SEQ ID NO:1432 |
| >DNP8NRG56 | (746307-746708) | SEQ ID NO:1433 |
| >DNP8NRG57 | (746391-746791) | SEQ ID NO:1434 |
| >DNP8NRG58 | (746418-746819) | SEQ ID NO:1435 |
| >DNP8NRG59 | (781373-781773) | SEQ ID NO:1436 |
| >DNP8NRG60 | (814481-814900) | SEQ ID NO:1437 |
| >DNP8NRG61 | (821982-822389) | SEQ ID NO:1438 |
| >DNP8NRG62 | (835563-835962) | SEQ ID NO:1439 |
| >DNP8NRG63 | (838331-838731) | SEQ ID NO:1440 |
| >DNP8NRG64 | (839998-840404) | SEQ ID NO:1441 |
| >DNP8NRG65 | (885543-885946) | SEQ ID NO:1442 |
| >DNP8NRG66 | (885952-886368) | SEQ ID NO:1443 |
| >DNP8NRG67 | (886899-887299) | SEQ ID NO:1444 |
| >DNP8NRG68 | (889323-889727) | SEQ ID NO:1445 |
| >DNP8NRG69 | (907972-908371) | SEQ ID NO:1446 |
| >DNP8NRG70 | (908004-908409) | SEQ ID NO:1447 |
| >DNP8NRG71 | (912248-912651) | SEQ ID NO:1448 |
| >DNP8NRG72 | (916934-917324) | SEQ ID NO:1449 |
| >DNP8NRG73 | (916938-917324) | SEQ ID NO:1450 |
| >DNP8NRG74 | (917136-917540) | SEQ ID NO:1451 |
| >DNP8NRG75 | (921592-921996) | SEQ ID NO:1452 |
| >DNP8NRG76 | (937564-937968) | SEQ ID NO:1453 |
| >DNP8NRG77 | (942470-942869) | SEQ ID NO:1454 |
| >DNP8NRG78 | (969787-970195) | SEQ ID NO:1455 |
| >DNP8NRG79 | (971497-971910) | SEQ ID NO:1456 |
| >DNP8NRG80 | (976829-977234) | SEQ ID NO:1457 |
| >DNP8NRG81 | (994598-995046) | SEQ ID NO:1458 |
| >DNP8NRG82 | (1008128-1008529) | SEQ ID NO:1459 |
| >DNP8NRG83 | (1017221-1017622) | SEQ ID NO:1460 |
| >DNP8NRG84 | (1017253-1017654) | SEQ ID NO:1461 |
| >DNP8NRG85 | (1023202-1023604) | SEQ ID NO:1462 |
| >DNP8NRG86 | (1026814-1027220) | SEQ ID NO:1463 |
| >DNP8NRG87 | (1057535-1057938) | SEQ ID NO:1464 |
| >DNP8NRG88 | (1059443-1059843) | SEQ ID NO:1465 |
| >DNP8NRG89 | (1060750-1061151) | SEQ ID NO:1466 |
| >DNP8NRG90 | (1060754-1061154) | SEQ ID NO:1467 |
| >DNP8NRG91 | (1069634-1070038) | SEQ ID NO:1468 |
| >DNP8NRG92 | (1073580-1073983) | SEQ ID NO:1469 |
| >DNP8NRG93 | (1079328-1079731) | SEQ ID NO:1470 |
| >DNP8NRG94 | (1079341-1079742) | SEQ ID NO:1471 |
| >DNP8NRG95__GTG__replaced | (1079520-1079922) | SEQ ID NO:1472 |
| >DNP8NRG96 | (1080309-1080716) | SEQ ID NO:1473 |
| >DNP8NRG97 | (1101462-1101859) | SEQ ID NO:1474 |
| >DNP8NRG98 | (1103451-1103850) | SEQ ID NO:1475 |
| >DNP8NRG99 | (1113942-1114351) | SEQ ID NO:1476 |
| >DNP8NRG100 | (1116221-1116620) | SEQ ID NO:1477 |
| >DNP8NRG101 | (1258787-1259186) | SEQ ID NO:1478 |
| >DNP8NRG102 | (1301482-1301881) | SEQ ID NO:1479 |
| >DNP8NRG103 | (1308262-1308663) | SEQ ID NO:1480 |
| >DNP8NRG104 | (1311397-1311797) | SEQ ID NO:1481 |
| >DNP8NRG105 | (1311400-1311800) | SEQ ID NO:1482 |
| >DNP8NRG106 | (1330322-1330722) | SEQ ID NO:1483 |
| >DNP8NRG107 | (1348406-1348821) | SEQ ID NO:1484 |
| >DNP8NRG108 | (825939-826341) | SEQ ID NO:1485 |
| >DNP8NRG109 | (18032-18432) | SEQ ID NO:1486 |

TABLE 2-continued

Microsatellites, SNP's, and insertions/deletions in the 1.5 Mb sequence.

| | | |
|---|---|---|
| >DNP8NRG110 | (125397-125796) | SEQ ID NO:1487 |
| >DNP8NRG111 | (129763-130163) | SEQ ID NO:1488 |
| >DNP8NRG112 | (130279-13068 1) | SEQ ID NO:1489 |
| >DNP8NRG113 | (138522-138923) | SEQ ID NO:1490 |
| >DNP8NRG114 | (141659-142057) | SEQ ID NO:1491 |
| >DNP8NRG115 | (162344-162743) | SEQ ID NO:1492 |
| >DNP8NRG116 | (177349-177753) | SEQ ID NO:1493 |
| >DNP8NRG117 | (179402-179802) | SEQ ID NO:1494 |
| >DNP8NRG118 | (190444-190846) | SEQ ID NO:1495 |
| >DNP8NRG119 | (193592-193993) | SEQ ID NO:1496 |
| >DNP8NRG120 | (234109-234510) | SEQ ID NO:1497 |
| >DNP8NRG121 | (384180-384580) | SEQ ID NO:1498 |
| >DNP8NRG122 | (677776-678175) | SEQ ID NO:1499 |
| >DNP8NRG123 | (680065-680464) | SEQ ID NO:1500 |
| >DPN8NRG124 | (688548-688948) | SEQ ID NO:1501 |
| >DNP8NRG125 | (693295-693694) | SEQ ID NO:1502 |
| >DNP8NRG126 | (696051-696450) | SEQ ID NO:1503 |
| >DNP8NRG127 | (699611-700011) | SEQ ID NO:1504 |
| >DNP8NRG128 | (706257-706657) | SEQ ID NO:1505 |
| >DNP8NRG129 | (807981-808380) | SEQ ID NO:1506 |
| >DNP8NRG130 | (810704-811104) | SEQ ID NO:1507 |
| >DNP8NRG131 | (819430-819831) | SEQ ID NO:1508 |
| >DNP8NRG132 | (826566-826964) | SEQ ID NO:1509 |
| >DNP8NRG133 | (844056-844456) | SEQ ID NO:1510 |
| >DNP8NRG134 | (846499-846898) | SEQ ID NO:1511 |
| >DNP8NRG135 | (959196-959597) | SEQ ID NO:1512 |
| >DNP8NRG136 | (959602-960002) | SEQ ID NO:1513 |
| >DNP8NRG137 | (961294-961694) | SEQ ID NO:1514 |
| >DNP8NRG138 | (962538-962940) | SEQ ID NO:1515 |
| >DNP8NRG139 | (963178-963579) | SEQ ID NO:1516 |
| >DNP8NRG140 | (968885-969286) | SEQ ID NO:1517 |
| >DNP8NRG141 | (1074891-1075295) | SEQ ID NO:1518 |
| >DNP8NRG142 | (1083125-1083524) | SEQ ID NO:1519 |
| >DNP8NRG143 | (1088956-1089356) | SEQ ID NO:1520 |
| >DNP8NRG144 | (1089985-1090384) | SEQ ID NO:1521 |
| >DNP8NRG145 | (1091481-1091880) | SEQ ID NO:1522 |
| >DNP8NRG146 | (1097289-1097688) | SEQ ID NO:1523 |
| >DNP8NRG147 | (1266466-126686) | SEQ ID NO:1524 |
| >DNP8NRG148 | (1277599-1277999) | SEQ ID NO:1525 |
| >DNP8NRG149 | (114359-114760) | SEQ ID NO:1526 |
| >DNP8NRG150 | (115359-115758) | SEQ ID NO:1527 |
| >DNP8NRG151 | (681200-681599) | SEQ ID NO:1528 |
| >DNP8NRG152 | (1085352-1085751) | SEQ ID NO:1529 |
| >DNP8NRG153 | (1275551-1275950) | SEQ ID NO:1530 |
| >DNP8NRG154 | (1276873-1277273) | SEQ ID NO:1531 |

TABLE 3

```
SNPs and Markers                                                   SEQ ID NO:

SNP8NRG102266_allelePos = 201 total len = 401 SNP = R chr8         SEQ ID NO: 1532
SNP8NRG103492_allelePos = 201 total len = 401 SNP = K chr8         SEQ ID NO: 1533
SNP8NRG126796_allelePos = 201 total len = 401 SNP = X(del) chr8    SEQ ID NO: 1534
SNP8NRG126990_allelePos = 201 total len = 401 SNP = X(del) chr8    SEQ ID NO: 1535
SNP8NRG131197_allelePos = 201 total len = 403 SNP = X(del) chr8    SEQ ID NO: 1536
SNP8NRG157747_allelePos = 201 total len = 401 SNP = W chr8         SEQ ID NO: 1537
SNP8NRG240979_allelePos = 201 total len = 401 SNP = R chr8         SEQ ID NO: 1538
SNP8NRG241017_allelePos = 201 total len = 401 SNP = R chr8         SEQ ID NO: 1539
SNP8NRG241942_allelePos = 201 total len = 401 SNP = W chr8         SEQ ID NO: 1540
SNP8NRG242526_allelePos = 201 total len = 401 SNP = M chr8         SEQ ID NO: 1541
SNP8NRG242556_allelePos = 201 total len = 401 SNP = Y chr8         SEQ ID NO: 1542
SNP8NRG242969_allelePos = 201 total len = 401 SNP = R chr8         SEQ ID NO: 1543
SNP8NRGU1136E144_allelePos = 201 total len = 401 SNP = W chr8      SEQ ID NO: 1544
SNP8NRGU948E144_allelePos = 201 total len = 401 SNP = Y chr8       SEQ ID NO: 1545
SNP8NRGU798E144_allelePos = 201 total len = 401 SNP = K chr8       SEQ ID NO: 1546
SNP8NRGU790E144_allelePos = 201 total len = 401 SNP = R chr8       SEQ ID NO: 1547
SNP8NRGU690E144_allelePos = 201 total len = 401 SNP = W chr8       SEQ ID NO: 1548
NRG1 exon E1006A                                                             SEQ ID NO: 1549
SNP8NRG1K250E1006_allelePos = 201 total len = 401 SNP = K chr8     SEQ ID NO: 1550
SNP8NRGR573E1006_allelePos = 201 total len = 401 SNP = R chr8      SEQ ID NO: 1551
SNP8NRGY672E1006_allelePos = 201 total len = 401 SNP = Y chr8      SEQ ID NO: 1552
SNP8NRGR676E1006_allelePos = 201 total len = 401 SNP = Y chr8      SEQ ID NO: 1553
```

TABLE 3-continued

| SNPs and Markers | SEQ ID NO: |
|---|---|
| SNP8NRGY734E1006_allelePos = 201 total len = 401 SNP = Y chr8 | SEQ ID NO: 1554 |
| SNP8NRGYD16E1006_allelePos = 201 total len = 401 SNP = Y chr8 | SEQ ID NO: 1555 |
| SNP8NRGYD29E1006_allelePos = 201 total len = 401 SNP = Y chr8 | SEQ ID NO: 1556 |
| SNP8NRGRD145E1006_allelePos = 201 total len = 401 SNP = R chr8 | SEQ ID NO: 1557 |
| SNP8NRG247229_allelePos = 201 total len = 401 SNP = Y chr8 | SEQ ID NO: 1558 |
| SNP8NRG307561_allelePos = 201 total len = 401 SNP = R chr8 | SEQ ID NO: 1559 |
| SNP8NRG385093_allelePos = 201 total len = 401 SNP = R chr8 | SEQ ID NO: 1560 |
| SNP8NRG426304_allelePos = 201 total len = 401 SNP = R chr8 | SEQ ID NO: 1561 |
| TSC0749797_allelePos = 201 total len = 401 SNP = Y chr8 | SEQ ID NO: 1562 |
| TSC0567738_allelePos = 201 total len = 401 SNP = R chr8 | SEQ ID NO: 1563 |
| TSC0287246_allelePos = 201 total len = 401 SNP = R chr8 | SEQ ID NO: 1564 |
| SNP8NRG449328_allelePos = 201 total len = 401 SNP = Y chr8 | SEQ ID NO: 1565 |
| SNP8NRG449661_allelePos = 201 total len = 401 SNP = Y chr8 | SEQ ID NO: 1566 |
| TSC0547311_allelePos = 201 total len = 401 SNP = S chr8 | SEQ ID NO: 1567 |
| SNP8NRG552169_allelePos = 201 total len = 401 SNP = Y chr8 | SEQ ID NO: 1568 |
| SNP8NRG552416_allelePos = 201 total len = 401 SNP = X chr8 | SEQ ID NO: 1569 |
| SNP8NRG593202_allelePos = 201 total len = 401 SNP = R chr8v | SEQ ID NO: 1570 |
| SNP8NRG652833_allelePos = 201 total len = 401 SNP = R chr8 | SEQ ID NO: 1571 |
| SNP8NRG657415_allelePos = 201 total len = 401 SNP = S chr8 | SEQ ID NO: 1572 |
| TSC0543535_allelePos = 201 total len = 401 SNP = R chr8 | SEQ ID NO: 1573 |
| SNP8NRG666856_allelePos = 201 total len = 401 SNP = Y chr8 | SEQ ID NO: 1574 |
| SNP8NRG729427_allelePos = 201 total len = 401 SNP = K chr8 | SEQ ID NO: 1575 |
| SNP8NRG730825_allelePos = 201 total len = 401 SNP = R chr8 | SEQ ID NO: 1576 |
| SNP8NRG730877_allelePos = 201 total len = 401 SNP = W chr8 | SEQ ID NO: 1577 |
| SNPSNRG730878_allelePos = 201 total len = 401 SNP = W chr8 | SEQ ID NO: 1578 |
| SNP8NRG821066_allelePos = 201 total len = 401 SNP = R chr8 | SEQ ID NO: 1579 |
| SNP8NRG821268_allelePos = 201 total len = 401 SNP = Y chr8 | SEQ ID NO: 1580 |
| SNP8NRG821939_allelePos = 201 total len = 401 SNP = Y chr8 | SEQ ID NO: 1581 |
| SNP8NRGU634E92_allelePos = 201 total len = 401 SNP = K chr8 | SEQ ID NO: 1582 |
| SNP8NRG822474_allelePos = 201 total len = 401 SNP = Y chr8 | SEQ ID NO: 1583 |
| SNP8NRGYU149E92_allelePos = 201 total len = 401 SNP = Y chr8 | SEQ ID NO: 1584 |
| SNP8NRGU126E92_allelePos = 201 total len = 401 SNP = Y chr8 | SEQ ID NO: 1585 |
| SNP8NRGWU73E92_allelePos = 201 total len = 401 SNP = W chr8 | SEQ ID NO: 1586 |
| SNP8NRG823033_allelePos = 201 total len = 401 SNP = Y chr8 | SEQ ID NO: 1587 |
| SNP8NRGU56E92_allelePos = 201 total len = 401 SNP = W chr8 | SEQ ID NO: 1588 |
| SNP8NRGRU121E48_allelePos = 201 total len = 401 SNP = R chr8 | SEQ ID NO: 1589 |
| SNP8NRGU69E46_allelePos = 201 total len = 401 SNP = Y chr8 | SEQ ID NO: 1590 |
| SNP8NRG824949_allelePos = 201 total len = 401 SNP = Y chr8 | SEQ ID NO: 1591 |
| SNP8NRG825087_allelePos = 201 total len = 401 SNP = Y chr8 | SEQ ID NO: 1592 |
| SNP8NRGU262E35_allelePos = 201 total len = 401 SNP = R chr8 | SEQ ID NO: 1593 |
| SNP8NRG825250_allelePos = 201 total len = 401 SNP = R chr8 | SEQ ID NO: 1594 |
| SNP8NRGU183E35_allelePos = 201 total len = 401 SNP = Y cbr8 | SEQ ID NO: 1595 |
| SNP8NRGU116E35_allelePos = 201 total len = 401 SNP = Y chr8 | SEQ ID NO: 1596 |
| SNP8NRGU22E35_allelePos = 201 total len = 401 SNP = W chr8 | SEQ ID NO: 1597 |
| SNP8NRGD193E79_allelePos = 201 total len = 401 SNP = Y chr8 | SEQ ID NO: 1598 |
| SNP8NRGD401E79_allelePos = 201 total len = 401 SNP = K chr8 | SEQ ID NO: 1599 |
| SNP8NRG1116715_allelePos = 201 total len = 401 SNP = Y chr8 | SEQ ID NO: 1600 |
| SNP8NRGU1124E592_allelePos = 201 total len = 401 SNP = R chr8 | SEQ ID NO: 1601 |
| SNP8NRGU1083E592_allelePos = 201 total len = 401 SNP = R chr8 | SEQ ID NO: 1602 |
| SNP8NRGU963E592_allelePos = 201 total len = 401 SNP = R chr8 | SEQ ID NO: 1603 |
| SNP8NRGU857E592_allelePos = 201 total len = 401 SNP = Y chr8 | SEQ ID NO: 1604 |
| SNP8NRGU406E592_allelePos = 201 total len = 401 SNP = M chr8 | SEQ ID NO: 1605 |
| SNP8NRGYD312E592_allelePos = 201 total len = 401 SNP = Y chr8 | SEQ ID NO: 1606 |
| SNP8NRG1166872_allelePos = 201 total len = 401 SNP = R chr8 | SEQ ID NO: 1607 |
| SNP8NRG1166995_allelePos = 201 total len = 401 SNP = Y chr8 | SEQ ID NO: 1608 |
| SNP8NRG1167017_allelePos = 201 total len = 401 SNP = K chr8 | SEQ ID NO: 1609 |
| SNP8NRGU193E344_allelePos = 201 total len = 401 SNP = R chr8 | SEQ ID NO: 1610 |
| SNP8NRGMD162E122_allelePos = 201 total len = 401 SNP = M chr8 | SEQ ID NO: 1611 |
| SNP8NRGD288E122_allelePos = 201 total len = 401 SNP = K chr8 | SEQ ID NO: 1612 |
| SNP8NRGU439E51B_allelePos = 201 total len = 401 SNP = Y chr8 | SEQ ID NO: 1613 |
| SNP8NRGU101E51B_allelePos = 201 total len = 401 SNP = S chr8 | SEQ ID NO: 1614 |
| SNP8NRGU59E51B_allelePos = 201 total len = 401 SNP = M chr8 | SEQ ID NO: 1615 |
| SNP8NRGU46E51B_allelePos = 201 total len = 401 SNP = R chr8 | SEQ ID NO: 1616 |
| SNP8NRGU1714E1160_allelePos = 201 total len = 401 SNP = W chr8 | SEQ ID NO: 1617 |
| SNP8NRGU1563E1160_allelePos = 201 total len = 401 SNP = R chr8 | SEQ ID NO: 1618 |
| SNP8NRGU1405E1160_allelePos = 201 total len = 401 SNP = S chr8 | SEQ ID NO: 1619 |
| SNP8NRGU1388E1160_allelePos = 201-2 total len = 402 SNP = X chr8 | SEQ ID NO: 1620 |
| SNP8NRGU344E1160_allelePos = 201 total len = 401 SNP = R chr8 | SEQ ID NO: 1621 |
| SNP8NRGU304E1160_allelePos = 201-4 total len = 404 SNP = X chr8 | SEQ ID NO: 1622 |
| SNP8NRGKU91E1160_allelePos = 201 total len = 401 SNP = K chr8 | SEQ ID NO: 1623 |
| E1160A | SEQ ID NO: 1624 |
| SNP8NRG25E1160_allelePos = 201-4 total len = 403 SNP = X chr8 | SEQ ID NO: 1625 |
| SNP8NRG594E1160_allelePos = 201 total len = 401 SNP = M chr8 | SEQ ID NO: 1626 |
| SNP8NRGR629E1160_allelePos = 201 total len = 401 SNP = R chr8 | SEQ ID NO: 1627 |
| SNP8NRG773E1160_allelePos = 201 total len = 401 SNP = R chr8 | SEQ ID NO: 1628 |
| SNP8NRG872E1160_allelePos = 201 total len = 401 SNP = S chr8 | SEQ ID NO: 1629 |
| SNP8NRGU1152E290_allelePos = 201-5 total len = 405 SNP = X chr8 | SEQ ID NO: 1630 |

TABLE 3-continued

| SNPs and Markers | SEQ ID NO: |
|---|---|
| SNP8NRGU162E290_allelePos = 201 total len = 401 SNP = R chr8 | SEQ ID NO: 1631 |
| SNP8NRG83E290_allelePos = 201-2 total len = 402 SNP = R chr8 | SEQ ID NO: 1632 |
| SNP8NRGD208E290 allelePos = 201-4 total len = 404 SNP = X chr8 | SEQ ID NO: 1633 |
| SNP8NRGU70E68_allelePos = 201 total len = 401 SNP = R chr8 | SEQ ID NO: 1634 |
| E59A | SEQ ID NO: 1635 |
| SNP8NRG40E59_allelePos = 201 total len = 401 SNP '2 Y chr8 | SEQ ID NO: 1636 |
| SNP8NRG1349775_allelePos = 201 total len = 401 SNP = R chr8 | SEQ ID NO: 1637 |
| SNP8NRGU75E24_allelePos = 201 total len = 401 SNP = S chr8 | SEQ ID NO: 1638 |
| SNP8NRGU104E127_allelePos = 201 total len = 401 SNP = Y chr8 | SEQ ID NO: 1639 |
| SNP8NRGU101E127_allelePos = 201 total len = 401 SNP = M chr8 | SEQ ID NO: 1640 |
| SNP8NRGU92E127_allelePos = 201 total len = 401 SNP = R chr8 | SEQ ID NO: 1641 |
| SNP8NRGU26E127_allelePos = 201 total len = 401 SNP = X chr8 | SEQ ID NO: 1642 |
| SNP8NRGD77E127_allelePos = 201 total len = 401 SNP = M chr8 | SEQ ID NO: 1643 |
| SNP8NRGRU37E131_allelePos = 201 total len = 401 SNP = R chr8 | SEQ ID NO: 1644 |
| SNP8NRGU4E207_allelePos = 201 total len = 401 SNP = R chr8 | SEQ ID NO: 1645 |
| SNP8NRG35E207_allelePos = 201 total len = 401 SNP = R chr8 | SEQ ID NO: 1646 |
| E207A | SEQ ID NO: 1647 |
| E846A | SEQ ID NO: 1648 |
| SNP8NRG540E846_allelePos = 201 total len = 401 SNP = M chr8 | SEQ ID NO: 1649 |
| SNP8NRG579E846_allelePos = 201 total len = 401 SNP = K chr8 | SEQ ID NO: 1650 |
| SNP8NRG671E846_allelePos = 201-2 total len = 402 SNP = X chr8 | SEQ ID NO: 1651 |
| SNP8NRGD141E846_allelePos = 201 total len = 401 SNP = M chr8 | SEQ ID NO: 1652 |
| SNP8NRG1AGU315E32_allelePos = 201 total len = 401 SNP = W chr8 | SEQ ID NO: 1653 |
| SNP8NRG1AGU145E32_allelePos = 201 total len = 401 SNP = R chr8 | SEQ ID NO: 1654 |
| SNP8NRG1AGU621E77_allelePos = 201 total len = 401 SNP = Y chr8 | SEQ ID NO: 1655 |
| SNP8NRG1AGU486E77_allelePos = 201 total len = 401 SNP = R chr8 | SEQ ID NO: 1656 |
| SNP8NRG1AGU325E77_allelePos = 201 total len = 401 SNP = K chr8 | SEQ ID NO: 1657 |
| SNP8NRG1AG135E213_allelePos = 201 total len = 401 SNP = Y chr8 | SEQ ID NO: 1658 |
| SNP8NRG1AG195E213_allelePos = 201 total len = 401 SNP = Y chr8 | SEQ ID NO: 1659 |
| E558B | SEQ ID NO: 1660 |
| SNP8NRG1AG470E558_allelePos = 201 total len = 401 SNP = X chr8 | SEQ ID NO: 1661 |
| SNP8NRG1AG530E558_allelePos = 201 total len = 401 SNP = R chr8 | SEQ ID NO: 1662 |
| E178B | SEQ ID NO: 1663 |
| SNP8NRG1AG37E178_allelePos = 201 total len = 401 SNP = R chr8 | SEQ ID NO: 1664 |
| SNP8NRG1AGD71E178_allelePos = 201 total len = 401 SNP = R chr8 | SEQ ID NO: 1665 |
| SNP8NRG1AGU91E262_allelePos = 201 total len = 401 SNP = Y chr8 | SEQ ID NO: 1666 |
| SNP8NRG1AGU13E475_allelePos = 201 total len = 401 SNP = K chr8 | SEQ ID NO: 1667 |
| SNP8NRG157556_allelePos = 201 total len = 401 SNP = Y chr8 | SEQ ID NO: 1668 |
| SNP8NRG241930_allelePos = 201 total len = 401 SNP = K chr8 | SEQ ID NO: 1669 |
| SNP8NRG243177_allelePos = 201 total len = 401 SNP = Y chr8 | SEQ ID NO: 1670 |
| SNP8NRG444511_allelePos = 201 total len = 401 SNP = W chr8 | SEQ ID NO: 1671 |
| SNP8NRG449280_allelePos = 201 total len = 401 SNP = R chr8 | SEQ ID NO: 1672 |
| TSC0707270_allelePos = 201 total len = 401 SNP = W chr8 | SEQ ID NO: 1673 |
| TSC0707290_allelePos = 201 total len = 401 SNP = R chr8 | SEQ ID NO: 1674 | n = A or T or G or C, unknown or other
X = deletion

Appendix I: Nucleic acid and amino acid sequences (SEQ ID NO: 1-39)

Appendix II: SNP and microsattellite (SEQ ID NO:40-1531)

Appendix III: SNP and microsattellite (SEQ ID NO: 1532-1674)

While this invention has been particularly shown and described with reference to preferred embodiments thereof, it will be understood by those skilled in the art that various changes in form and details may be made therein without departing from the spirit and scope of the invention as defined by the appended claims.

The compact disk having file name 2345.2004-006 SEQUENCE LISTING.txt and comprising SEQ ID Nos: 1 through 1674, created Aug. 15, 2002 and being 2,755 KB in size, is hereby incorporated by reference in its entirety.

SEQUENCE LISTING (1674 sequences)

SEQ ID NO: 1 - DNA, 1503841 bp, Homo sapiens
  misc_feature (1)...(1503841): r=g or a
  misc_feature (1)...(1503841): y=t/u or c
  misc_feature (1)...(1503841): m=a or c
  misc_feature (1)...(1503841): k=g or t/u
  misc_feature (1)...(1503841): s=g or c
  misc_feature (1)...(1503841): w=a or t/u
  misc_feature (1)...(1503841): b=g or c or t/u
  misc_feature (1)...(1503841): d=a or g or t/u
  misc_feature (1)...(1503841): h=a or c or t/u
  misc_feature (1)...(1503841): v=a or g or c
  misc_feature (1)...(1503841): n=a or g or c or t/u
caagcactttataccactttttataaaataagccctcactttcattacattatttaactygtatttctgccttgtgttatagatagaaagtatattattatttctactttatagctgaagaaactgagtccaaaatgggtagagcaactggcactaaagatcacctagccagtccgagwtcacacagtcagtattaggactggggccttgtgccttccagtgcagggtcccttacaccagtcatgacatagatgcccagatcatgcatgacttgatgtaaaaacaacaatttttgttgtcccagtttgagtccttataaatttcccctgtcaaagaaataaacatgcaactctcagaaattatcttttatggagcttttaaaggccactttgccaargggagctatatarccatgacataaacatgaagatggattgacagaaaatactctttcacaggctggaggaaatattgggggaaagaaattttctcagactgcccttccaacgtggcatggatcatggaggtcagcttttctagcttgtgcccagaggtctgtctacctcagctgtgtcttgtgattgataggaggatacagtctcccagggtgtgatttaaggtggagcttataggtctacaaagctcaagctctwatcaagctactatggcatgatagtacaattataaagaaagtagactagtttctataagctgtgtataaaaccaggcccaccctaacatttgcagggcctaggccaagagtgtatgtagagtctcatataccgtatgtctaaatatttcaaagttataaaccaagaagggcctgtggcccaaactgtgttcccaccctaagcctggtagaggcttctcacaggtgtccttgggagtccctccaggaccagccctgctgcttgccagtctgcatggtcacctggatgtgctgagtcaaaggcaggtggagctgggtgaaagtctgtggttttcagtgaggactggagattctcaaatctgggattgggaactgactcagtcaagcgcctcaaggagctagggtgctccttgagcaggttcctctcctccttatttcaatttgctgattaagaacttctagacagttctaagcccctttcaaacaacacacgtttttagcaaatgagaagaagaaagcttggtcatgttagaaatagtcctgtccagacacacacttcagagcaatctggaatggccattccccaagcatgggctgcaattcctttctcccctgtgtctccctaacgcccacacccactcatcagctcttagttcagcacactggcctgtgggtccgagtttggtgtgtgccgcatccctctcctataaactctttttgctcaataaattactgaatcttcaaaagaaaaatttttaaataagaccaaaaccacaaaacaaagcaaacaacagtgacctggtattttggcattcattttgtgtggggccctctaaagcagagggtcctggaggagtctcttcagtccaatggctgaattactccaagactctttcatacaaaagttagctgggcatggtggcatgcgcctgtagtcccagctacttgggagactgaggcgggagaatcacttgaacctgggaggcggaggttgcagtgagccaagattgtgtcattgccctytagcctgggtgacagagcaagactccatctcaaaaaacaaaacaaaacaaaacaaaaaaaactctttctttactttataaccatatggcaggacatctcagttcatctatgacctgtggttttaaagtaaattctgtttaaagttatctttaaaatagctttatttttgttaaaatagagccatatcttcatctgcgggaaatcatattgactccatgataagctatattctggaaaatagtcagtgtgctgacgattgctacctgtgagtagctcacccaacccayaggcaaagtagcaaagagagaggcatggcaacccccaacgtgagaggcttgtagacaacccacagttctagcagatgtcagtgcaacggggcaaatttcatccccctcagagcatggctctgggcaccactggacacatctgtttcaggataatttgaagtccagttgttcagacagagttgatcttaagaccatggtggctactgctgaattttttcagataaagttagtaaaatccgaagttcacccaggtggttgatggcaatatgaactctatataatactgtctgatgccaagtatcttagtcaactcaggctgccataacagaataccacagaccaggtggtttaaacagcagatatttacctttcacagctctggaaactgggaagtctgggattaagctgccagcatggtcaggttctggtgaggggtcacctcttggcttgcaggtgtccaccttcttgccgtgtgctgtgtgtggtggagagatctctccttacragggccctgattccatcatgagcccatctaaccatgattacctcccagaagccccacctccaaataccatcccattgggggttagggtttcaacatatgaattttgagaggacacagacattcagtccataacaccaaatctgtattcatcctagttcagcacagagcagaacctatgtttacccaatatcctttgaatactagttctgaccatagcctttgtaatttaaaagctctacagtcattttttttgaattataaatgcaatacacacttttactagaaaataggaaaaaattaaataaaacttatccataattccaccaatttgagactaacagttggtttcttttcttccaaacacatatgtgtatataaatatacgcatatatacttccataaacaacatatttttaaaatgaaattagattcatactgttgaggttttttttttttttttaatcttacttctttcaacatgctttaaatagtaagcttttcccttgtcctaaaaaaatttttacttcttcactttttaatgttttggctgtctggaccataaattatctgcatttatatcttatattatttagaaaatatatatctgcttttaatcccctcgtttttaacttttaatttttcaaatggattttaaaagctgtgtttttgctaagtatcaactcaagaaggaaatgttctcttttgagttctacctttgctagatgaagaatgtggcccacctctcctctcactaccccttcatgtcaaagccttggatttgtggggctttggatgttgtgcttattttttgaaataaaaataaatgaacaatttcctatatatagaaaattattatgcatataaaccatgcatttttatcacaaaggattttagttggcagttttctgcaatatactagttattttcacaaggtggaaatccagaggattgattgacttgaatcctgaatccctacatcctctatcagcacccagtgttcttgcaggttttcaaagaaactctccctgctattaggctaaggctttagattcaaatactcatagagaatcttagccctaggctaaaaatagggcccacctttagcatgggccgtattttgttccttcttccatggatatgtctggagcagtcttctttagttctgattcctggccaacatcatagaaagatgaatcctttaggaagtgcaccaaagaaggagcacttttgcataatgactagagctcctcatctctgccaaccaccccaagtctctctctctttttattttttatttttttgctgggcccaaccccttgtttctgtttgagcaaaatgcataaacttagaacagacattcttaagccttgtgctgtgttacactgttgtactacgagcatttgacttatttttgctggaaccatgaatatgtcttgaaaggctgctgtctgctggatgaaacactgagctaagcaggtcatacaacaggctgtagagtaggagctccaacttggaactaaggggcataaagtgtggtaccctgcccactggtgtcaaagaaaaattaagcattcaaaggaacatgtgagggctttgctttctgacagtgtggttctggctatactgagggttatcttttaaaactagcatggtatagaagagtgacctcatggacagtgcagtaactagatgcttccaaagggtgtgagatgctgcttttctctagtagtatttgtgttataattattcctggcttgtttgcctttagtatttttttgactgccaaaaattatagcattcaaaaaatgtgccacaaaaacaacaaagttgacaactactgatctggaacctttctaaatgtgaccagtcagagaccatagccaatattttctattgtctatagaatgggatgggcagagaaaacagctaacaaaaaaggaaaaaacaacccaaaatatttcatggtttcagctttattagcmtaacagtcaagttgttytggttccacgacttttaaattaagcgaaggagaactctcccatcaataggttcattgtgatgccaaactttacatattttggaaaaacattcatttacccgccaggcaagctgcctsctctcttagagttcgtggtagggaactataagcataaagacctttctgaggaggttttccttattttattgactgcctcatatatttacaacttcccaatttattttttcagactgctaactcctgtgttcctagattcccatttttcaattgattgtgggctttttctagggttacagatttaacttccatgcaagtggtggggtgtcccacatcaggaccttgtatattctaactctaaacactcttcgtatttctgtatgtctccagaccagcaaacttacacagtcttcttgttattgatatttgccttttgtgtgttccaagagcatatccctaagtgcacagaagatgtgatttttcttctgtcattgtctccaaaacctcttctttcctgcatctgaagtccccagaccctggataagatttctactttgttgcactgaggaacagaacttttccctttttatttacagaagggtctggctcttatcacctctgaatagcatgccattctcttagcctcatctaagaaacagactgtaggggaagagaagatctagaatgttggtcaccaaccaatggcagacattatcaggtaagaaacctgcccacccaaactctggaccctaatatgcaagtctaactagttccataaaaccaatccctgctaaccccacaaacaggttgcctatagccttacaagtggcctccttggtttttagtggcatagtgcaggtgagccatatattatgcttctcaatttatttccattggtcagaaaactggtaaaaaattccttttcaatggtatagttttcgaatctcaacagagacttctttggtcttagtgatgagtcttcatggtattttggcttgcaygtagtaacaataatcaagtcattcacccagtgcaagattttggtgtctttatttttaactatttgtattgtgcattatcacatagataaccatttgttttgctggtctcattgctcacgtagaagtctgaatataattctttctcagagtgtgggaaatcatggattgatattcttagtttttgatgtagtgctttttatttttaaccttcttagacaatttgtgagcaaggaagtcaggaactgtgagccacctgccatcttaatttgacatctagtctcactactttcaagcacctccacttcaaaatactcttacaagtgaatcaccattgttaaatggatctttgaaggaattttgacaaccagactgaaaacaatctagacatcttagatatttgtggcttcacagaaaataaaataaaacaacccwtttcagcatcaagttatattttccatagctacagaatctggtaaataactatgttactcattcatctaggtagtttgatactacctactgatactggagttggggagggaagtgctgggaagggaagggtgtggtccctggctagggctccacccctgggcctgtgcccatgaacctaggtgaggacaggcatttctgtttttgtgcccaaatgttgcatttcccaagaccaacctggcctaccacacccctctcctgtgcctataaaaactcccaataccctagctagcaagcacacagcaactggatgtcgagaggaacacaccagcagaataagatacaagtggctgggcattgaggggaatgctctggcgtaagagcacatcaacagatgccggcaggccagcaggctattgaccagcaggacgaggtgaagtttggctggggcagtcgaaggagagagctccactgctgagtggccgactccaggggaaaaccaccttcccactccatctcccttctggctcccccatctgctgagagctacttccgctcgctaaaatctttgcactcattctccaagcccatgtgtgatctgattctgctggtataccaaggcaagaaccctgggatacagaaagccctctgtccttgcgataaggcaaagggtctaattgagctgactaatgcaagccgcctacagrgagctaaactgaaagagcacactgtaacacatgcccactggggcttcaggagctgtaaacattcrcccctagacactgctgtggggttggagccccacagcctgcccgtctgcatgctcccccttgaggtttgagcagcggggcaccagagaagtgagccactctccctgtggcacaccctgtgaggggsacaagggaacttttcccattttactaccaaggccagtgacatgaatgatcaaatacyaaccagctacattttatttaatttttaatttttttagttgtcagaagattttattaactgtaagccagggaatggactgatcgattttattatgcaaatcaatgaaaaaaaaaaactcttttagaaggacacaaacacacacacgtgctcacagggaagctggttgttggttgagagtcaggtcagaaccttggagagctcaagataaagcgggggcagaaccacaatcagaagcttccatggctgccccccacatggatgagttttatttaattatttttttccttcaacttttattataagctcaggggtacatatgcaggatgtgcaggtttgtgacataggtaaacctgtgccatggcggtttgctgtacagatcttcctgtcacctaggtattaaacccagcacccattaactattcttcctgatgctctcaaccagctacattttaaaccctattttctctaaagatacatcaacagattagcttattcttcagtcctggatctaacataatttgtacagtaaagtgaagataaagtttattcagattatttgtacaagtactttctcatcaaagtgcagcagtctactttctgtttcccatgggtgataggagatagggttaaygaaacagcagtaatttagagaccagttttagctgcatattgcartctttctttagaactatcctaaaagctgtctgttgctttgaaatgaatcttacttccatttcctccttttcttttggacctgctcaggagcaataaaatagagcaaatgtaaacagcagaaatgagacagaaggggacttggagataaaagaaatttgtttcttctgcattcttcagaatgcagagtagttcctggcagagagtagatgctaagttaatgtttgtcaaattaagtgcataacccgaatattcagaatagaaatctaaatagtttttacttgcctgaacacaggaaccttactcctagaaaatttggctggctagcagaaacaactttaagtgccttgaaaaaataagtaacagatgataggttgcttctaactggaggctggtggaagacaacatcacattaggtctaggggaggattattacttgggaaggtgggcttgagtcagtgatgggttgagaggatgcggtagtaaccaaacaggtcagccaagccagcagccatcagggatggagccaaggcaaacttcaagcagacaatgctgaatacaaaccatgtctaccttctcagattgcctcccacccacctttctctttacatattggtgtaatagctatgctgattagcctgtctccttctggatgtgggtgaaaggccacattctggagtttaggacctgctttttcaagtggtactcaggggattaaatgacacaatccagaagtgtgtgtgaggagtgattagctccctgcatgtaaaacttgataaaagaaaaatgaaagacaggagtcctcgcttccttctttctttcaaggactactccaaggtgagatttcatttgcacattttcttaagaagtcctgagagctgggcagacatggttgcatcctggcccttgtgttgcttctttctcctctcaccctcattcttctagcctttcatttcccaactaaagggtcaaccctttcattctttcttcaggctctgctttctaagaaatcaggagtaaggtactgactaccccagagctgtctcacttggagctctttccctcaagcttttctgtttagtgtttttgtttgccatccaaggacataaaaagagaaggatccttcctcaaaaaccatgccctcagtctcctatgttactcctttttttggtgctgtgtaatagttatttyacaccataataaatattagctatacttgccattgtataggtgtaggggaggatgaggaggttcaaactgtattcccaacatcataacttcctgttacatccaagagctgttgaacaatatcgagtttcccaacrtatgtgtgattggaatcaaaggaggagaagaaagggagacagttcagaagataatatctgtggaaataatggctgggaattttcaaaaaataatgacagaaaccaaaccacagatccaggagtctcagagaacagcaagaacaaaaaaacaaaaaacactcactcctctccctacatacacatgctgtggcatagcataaaaccaaaaaaacagacaaaaycttaaaggtagtcagagaaaacraaacattacataaagmggaacaaaggtacagtggtgcaaagaattacagtaaactttttgtcagaaactatgcaagccagagacaatggagcaacaactctaaagtgctgaaagaaaagtatttgttaaccaaaaattctacaccttgtgaaaataccttaaaaactcaaggtaaataaagattttcttagacacacaaaaatggtgagaattcattttcagcagacctactgtatgagaaatattaaaagatgttcttcaggcagaaaaaaataatatatcagactgcaatgtagacctatacgaggaaataaatttcattctttctttaagatactgactaccctaaagctgtctcacctagagccctttccctcaacttttcttttcttttctctctctctctctcccttcctttctgtcttctcttctcttctcttttcttttcatttcttttctttctttttgacagagtttcactctgtctcccaggctggagtgtgatatcggctaactgcaacctctgcctcctggcttcaagagatccttgtgcctcagcatcctgagtagctggaattacaggtgtgtgccaccatgcctggctaatttttgtattttcagtagagtcggggggtttcaccatgttggccaggctggtctcaaactcttgacctcaagtgatctacctgccttggccttccaaagtgctgggattacaggtgtgagccactgcacctgacaccccctcaaacttttctatttagtgttttgtgtttgtaattcaaggacataacgagaaaagagttcttcctcaaaaaccataccttcagtcccctatgttattccttttttagttctcttactctgtaaaattctttcacactataataaatattagctatacttgcctaggtataggtgtagtaggtggtgaaaatggaaataatgaaggtaaaattaaattaattttctaaatattcttaattactctaaaacaatggttctgaaccccaggagatccctttccattacgattcttccccatgggaacactggcaatgtctggagacatttttgattgtcacagcyggggtggtgctactaatgctagtaggtaaaggtctgggatgctgctgaacaccctactatacatgggacagactcacacaaacagaattctccagtccaaaatattaatattgctgaagtttagagaatctgctctaaaagataacttctaaagcaaaaacagtaacactgtattgtgtgtttacagtatatataaaagtagagggtatgaaagcaatagtacgattaatgggggggaggaattgggactaactattgtgatgtccctacatagcacaggaaacaatgttatttgaaggtaggctcttgttaattaaagacgyatattttaaaacctaagacagccaataaaaataattaagataaaatggaataataaaatacattcaattaaaaaagaagagcctgaaaaggagagcagaaactaaagaatagatagaacaaatataaaacagctagcaagatggtggattttaattgagccatttaaataaccacataaacctcatttawtgagacctgaattaacttaaaaccaaatcaaagacatgacaaaagaaaaatgttatgtcattatccctcatggacatatctatccacatcaaaatacattagtcccacttattggtgggggatattttccaagaccctcagtggattcctggaactgcagatgataccaaaccctatatatactatgcatgaatttcttgttccttcttcacaacagataaagtcacagatggaaaattagttttcatcatggatcttagtaacttcagcatacgattttttttctttccatattaagtcaagaactttcaccttttcacttaaaggaggcactgatgscttcttttttggtagatctgaatggctagcatcactactcttgtgctctagggccattacaaagtaaactaagaatgacttgaacacaarcatcacaatactggatactatgatggttggtctgataaataagacaactcctgagtgagtaacaggtgtgggrgagggtacagacacatggataccctggacaaaaggaggattcaccttcctggtggggcagagccaggcggtgtgagattttgtcatgctatccagagtggtgtgcaatttaaaatgygtgaattgtttatttgtggaattttccatttaatatttccagaacaccactgaccataggtaactgaaactgtagaaagtgaaaccatgaataagaggagactattgtattggcaagttgaatatagcaattttcaactttttattwaaaaagttgaaaattactaggctgggtgcagtaattaaaattaaaaaatttaaaaatattaaaatttttattttaatatttttaaattaaaatatgtaaaaatactaggctgggcgcagtggctcatgtctgtaatcccagcacttcaggaggccgaggttggggaactgcctgaggccaggagtttgagaccagcctgaccaacatggtgaaaccctgtctctactaaaaatacaaaaattagctgggtatgggggtgtgcctgtaatcccagctacttgggaaactgaggcaggagaatcacttgaacctgggaggcagaggttgcagtgagctgagatagcaccactgccattcagcctrggtgacatagtgagactccatctcaaaaacaaaaacaaaaacaataaacaaaaaaacactacacagtgaagtgaggcttacatgggcatgtcatgctggttcaatactaaaaaaattcagtcaatgtaactcatcatattaatgatgtaaagaaaagccacttgatcatatcgacagatgcagaaaaagcatktgaaaaattcaccagccattcatgatgaaaagtgtcagcaaactactaacagaaggaacttcctcagcctgataaagggcatataaaaaaactgtatagctaacatcatttttaatgctgaaagactgaattcttactctctgaaatcaagaacaaagcaggaacgccactctccccagtcctataatttacagcactagatgtcttaactagtccactgaagcaataagaagaaataaaaggcatggaggttgraagaagaaaaaaactgcccctatttgcagacaacatgaacatttataaaatctaggaatttagaaaaaggcttctagaatgaaaagtaggtttatcaaaattgcgggacacaggccaatacccaaaaccaactgtttttccataaactggtaacaatcggaaaccacaatctgaaaatgatatcatttactatagctccaaaaaatgaaatacttaggtataaatctaagaaaacatgcataagatctgtatgctgaaacccacaaaacgctgatgaaagaaatcaaagaagacaaataaatggagcgacacatggtattcatggattagaagacttaagagagtaaagatgtcaattctccctcaactgatctatagacttaatgcaacaccaatcaaaatcccagcaagttttttcttgtaaataaagacaagctgattctaaagtttatatgcaaaagcaatggaactagaatagctaaaacaacttagaaaaagaatacagttagaggaatctcattactagattttaagacttactataaagcaacagtaatcaaggcaatgggatagacacatagatcgatggaacagaaaagataycccataaatagaccttcacaaatatggtaatttgatttttgataaaagtgtaaaataattcaatggagaaagggtggtcttttcaacacatggtgttggaacaatctgtcattcacatgcaaaaggagacatgcatcctcaactttatccctcataccaaaaattaattgactcatagctctaagtattcactgtaagactataaaatttttaggagaacacaggaccacagggacctctttgcttagttattcgggtcagagagaagtactttctttcagtttcatgcctcacattgctgtgtgcctagtgctgtatccgcctatgttgctgccttgagaatgcagcttcatgactgggacttgcttcagtctagggcagggagaacaaaaagaggaaaaaaaaatgaggatttgcccacagatcctccatcccacgggggcccttctttcaggttttctggttagaaacagaggatttctctgggaacyttttctgcccacagttgctgtgcagttcctggatttgcattgccctgcagtctaagctggaagatatggaatgaaaagatgtcaggaaattcactgccctctgggttactttcaggatttgattttcttcccaaatatgcctgctattatttactaatcagcctccagatgctcactttatgtattctgtccaaggattttcgccaccctttctgataccgcaaactgccctccgttttacctccctgcatttccaaatgcatcatcttagtacctcttagtagaactggagccactaattctttcctcttctccatgtgtttttttttttttttgaatcagagttttgctttgttacccaggctggtgtgctgtggtacaatcatagctcactgaagcctcacttcctggactcaagcgatccttgtagctgggactacaggcatgagccaccatgcctggctaagtttttctattttttgtagagatgagatcctgctatattgcccaggctggtcttgaactcctaggctcaagtaatcctcccactttggcttccccaagtgtgggactgcaggaataagccagggtgcctgactaagtttttctacttttgtagagatgagatcctgctatattgcacaggctggtcttgaactcctgggcttaagtgatcctcccactttggcctcccaaaatgtcgggattacaggcttgggccaccgtgtctggtcccaccaactttttgatggaagaagtcaggttcctcgtgtgggtgattgctttgaagtggaaacagcaccaggttctagccaacaagacataagggggccttctgggagaactattttgccctaacaaagagagcgacccatggagaaattctacctccctttctgccattgagcgttattgtataaggacatgatgctcagaagtgtggctgccaccttgtaccacaaaagaaaagcaaaaacattatagagaagcaaaactagagcccagatatgttgagcagtcaattagacaaacttgagccagttgcctttagactcctacttgtgtgggatcataaatttccaatatttaaaccacttttagtgagtagttttaaaattgcaacccaggtcattttaagttataaactaatattattccatttagggattcagccatccacaaaaataactgggatggaattaatgaatatttcttaataattaaattatgttttaaaaatatgggtgagttgctagtttattcactgatttgacatatgtgtgaagattgtttttatgtgttagaacaataaagctaaaaatggatatacaacctgaaaataaatatggattacatagaattattcttgatttctttgtggacttggagagatgttataattctattcatttaaaaaatttgtttaaatgtatggggtacaaatgcaattttgttacatgcatagattgtgtagtggtcaagtcaggacttgagggtatcatataattctattctttattttccttcattcacccttaagaaatattaattgggtgtccattatgtaccggaaactcattctaggttcttggggcactaagaagagccagaaaaagttgctgtttttaaagtgttaacagtatagtaggaaataaagacatatcaaccaatactgtagttaaaatgcagagtgatacaaactaatatatggacatgtataaaattattacaggaataaaaaaagctgttttgaggtatagtgtttctttcctatgataatggatttatataacacgtatgaatacagtccattttgtttggttctagattactgggtagtatcagatgctttaattttcataacttaagactttgaaaggaatatttgtcatagaaatgagtgaaaaatggcccctgtttattggcccctacattgtttgcttattcacagcacagtaggatggttagctcagaacctgccagggccaaacgcaaattctttcacagccaattgcttaaaggtagcccaaataagcatattttcagccacttacagctcacctgctttgcatcctctacacaattgcatttaacatctgctagccacagagaagacaaaccttgtagctgtagaagaccccaaactgctgcagcccttttgagctctctgagccagagactccctgtattgcttctgggcaataccacctggacacatgtgccccctcaccgatccccgtctcccctggaatttcccttgccctcttcttctgggtgtctctggramgtcttctgctgtgaggactttcccttttctgcaatcctgtccaataaagcttgcgttgtgcaatattgccttcttgttctatctttctgtcttttctttgatcagcccccagatcctcaaactcaccattgttctctgctattatttttcttttaatgygcattaatacacacacatatatatacacacacatatacacatatatacactctttggaattcttttccttgtatgtctcttcaatattctctcacacttccttcaaatgtctgcccaaaccttgcttctcaatgagtccttccttgaccaccctttctgatactgcaacctgccttccattttacctccctgcttttccaaatttcccttcccttgctctattttttttcttatttctctgctacttgttgtctattcacatactatatactttactcatatatgtttattgtttattgtatgtcactacctattaggatattatttcttcagaacttgaagatactgctccttggcctcagcagtttcactgttgctagtgacaagtcaagataagactatttccttcggtagccttgaaatttttccctagaaacttttaggttctcttgtttatctgtgtagttctgagctgcaccaactttttaaaagagagcagtcttgttctttcctaccatttgatacttagtaagcatttaattctgaagatgtgggtctttttttcagttctggaaacttttctgtgtgtatacccaaacacacacacacacacacacacacacacacacacacacacagagatctttctataaacataatacacatatataattctgtgtgtaaatataatacacatcatacacatagatacacacatgaacacacacataaaattttatatctgtgtgtattatatttatttcctctctgctattgtagaacttgtggatctgttttttatgcaactgaaggtttatctcatattttccacctctttttgtgatttttaatgttttatgaagaattctttagttcaatttgattttaatagctccattttccccttcagcctaccagttgagtttttaaatatgaccatatgtttaatttctaagatctcttttgttatatttttatagaaggcttttcttatttctctgagggtattaactgccttattttaaaactttattttcctttgtcttctatttgttgaatttggctcctgtcttttgtggatattaattttcctcaaatgttgtgtgattcttgtttggttgcccatatttttatttgagagtctccttttgcctcttggtggtctgagtacagaaccctgtctcagggggtctagggggaggtggggattgttgccgagtaggttgtgtgagaccataatcttccgggcgtaagtcactcttggggattgtgactgatggtggtagctggaattgttctcattgacaggcttttcttacacaagagtcaaccccaagttctagggctcaaatcttccatttctgagagctgtgctccctgcttttacttaggggctaaagccagaacctctgttccctttcaacgtttttcttcctttgttgtccacttcgaagtttagcagtactttggtctttgctcttctgttttcagccccaacatttctacaaagcctgtggctctaaaccttgtttgctcattgcaatcacctgggaagcttgagaaactactgaagccttggtcttacccccatccccacccccaccctgagatcttaatttatttcgtctggggagcagcttggatgctggcatttttctaaattttctagttgattttaatttacaaccaagattgctaaccacagtgctaggaaatggtctcaagcagatctttcctgtaagtgtattaaaagttcttggagtttatcgtagggcagaagccttctttatctgctgctcactgtaagaatcagataggaaggaagggggctgtctacacagcctttggtgacacagtttctttaattagtcatcttcttgtttgaccaatagcctttccttattttgtatctcttaaccttaataactgaacttgaagtacttagaattgcttttacttcaatagttgtttttattatttttcttagttgttttaggctaaagtttctcttccgttttttccccatcactctcctcttagtgatgtatgattttccaagattatttaaaatttctggtgcactgattggcgctatttttcagcatggcagtacattttttaaaaattatttttcttgttatttgcgtggatttgaagaggaatggatggacacatctgtgatcatactaccaaatttattccacctcctagttctatctccatttgtctttctctgctaatagatctataaaatgtggaaagagatgttttacaatctctcatagcaatcctattttttgttttacataatttgatgcttttatatgaaacataaagtttcatggctattataaattttatgtagattttgcctttcatgaatataaaatgaccttcttttctatggaaaccttttttttttttttttwaccttatattaaattttgtttgaaatcaaaggggccatcctttctgtttttaaaatttcatttgtctggtaagcctttgcttattctttcaaaacatttctcattttaatgtgtctctttaagcttaaatagcgtatgtctagatttttaaaatctttttttaaatggggagttgaaataacttaaatgtattatcataacttatatgcttggcctcatctccgttatcttgttttatatttttagattttatgctttcttgctgttttctggatttatgtcttttactttgtgtaatatgctttgtttgcttttaccttttccaatgttctgaaaggtaaacattcctcttaaaattttaattttggtttttagaaaatgatacttaacctattattagaaatttaaaaaaaattaaaatttccatcagaattcttacttgcaaacaatagaaactgactctggctagattaagcagaaaggaatcttctagaaggataaggagctgtccacagaattgataggaaggaaggttttacatggggagaagccactggtggctgcatggcaggactggctaggccacccccaggaatggcagctatctgattgcctctgtttttccatggtctttgtgttccctggacactggcaccagacacttcctcagccaccttccccacccctgctctggacactgagctccacagctgccactgctggatttctgaaaagtctctgctactaagcatcatttgtttcacatgaatgtcccaaacaagagcacaccacgggctaagcttaagcctccagcccatggcagagccaaaaggggtttgagagggcaagtttctggctttttcagcttggaagtgtggcaagttcttgcttgcacccttccccaagtcccagatctctgcccaatatttatccctcctctagttttattataatctcttctcaatattttataaattatgacaaaactgaaaagtgaaatacctctataccagaggtctccagtctttttggaagcagggaccagttttgtggaagacaatttttccatggatgtgggtgggaggggattcaagtgcattacatttattgtgcactttatttctattattattgtgttgtaatatataatgaaataattatacaactcaccataatgtagaatcagtgggagtctggagcttgttttccttcaactagatggtcccatctgggtgtgatgggagacagtgacagatcatcaggcattagattctcataaggagcacacaacctagatccctcgcatgtgtagttcacaataggattcatggtcctatgagaatctaatgctgccactgatctcacagaaggtggagctcaggcagtaacgtgagtgatggggagaggctgtaaatacagatgatgcttggctctcttgcccaccactcacctcctgcttttcagcctggttcctcccaggccctggactggtatcagtctgtggcccagggattggggacccctgctatatacaggggtaaaaaaagagggaagaagagagaatttggttaaaatatattcatagaaggaaggaagtgtgaagagaaatcacggtccttattgcttccattggttatrtggttgcagatccatgctgcccagtgaaagttcttgtaatgatgcaaatagtttgtacctgcactgttcaatgcagaagccacctgtggccagcaaacactcaaaatgtggctggtgaaatgagaaactaatattttaattgcatttaattttaattaatttacatttggatttaaatagccacrtaaggctggtggctccaatgctgtacagcgtagctgtgaatagaatgatattccctttgtcttcagccatacgtcagtgaactgggatctctcccagtctaattctttgctcaatttcaggacaaccgagaaacctagctaattttgcctctatgagacttccatagtcattcactcaaaactcatcattgaacatgttaagaaaggatctaaccatattttcctttgtccttatggagaaggagcaaccttatttcctttttgataattcatgtcaattactaggcaatcctgtaacactgcatttttatctgttcacccgatggtaaagggaatacagacagtctggtggcagttcactgggatggttatctccttccttgcaaacaaaacttccaaactagtggataacagctataagaatgtgtaaagttttttataagtacattaccaggtttaattcttagaggtatcacacctccttctgctccattgtttcctggacccatattctgactgtagaagaaagagaacatacctagaatccttcagggctgcaatctggcctgtctttcagctggagtgactcatttttccacagctcatggaaatgttctataagtctagctccagctgcttttagatgatgggatacataataaaactagtagctggtttattcattttttccccatcactgtaaagtgagttcctaggtcagaaacaatatcctttgaggcaccatgcctgtcatgactatatatgaggtattcagtaatggttgcacttgtagaagcatagttgggaaggaaagcatatcaaagtccaaataataagtgaagataaatggcacctttatcaggaaggaaggttgccaatgcaattaaccttgtgctaggtagctggctaggtrgctatcccccaaaggcatggtattatattgggggctccaggttggtcttttaatgggaaagttgagcaaacagcagatgtgttatctagggaagagagggttggctgacaatagagaaggtmattttatctacctgattattaaaagcatccctgcactgggtattcacgtttgatacaaatattctctccctttgggcccattctgagggtcctctagaatagtagctgaaattggggttaaaagctgcttaaattttgacagtctgctttacttctctaaataccagacatcttcaccaggttattcccttgatcttgtgtcctgatattatgaccatgcctctggcatttaagtgccccatgtggcctctgtcaccctcagatcttcccattttctttaaaatcaaggaaacaatttcactgcatcatgttctactggtctccctgtcccatagggacctgctcaagctgttacaaagaatatagagtgtcagtggtgaaatctatgtcaataaatacagtcttatgtaatatattctcccctccttgtccaatattgtctgaatccattcacatatatattccccatatgttttgccagcataaacaggtgaggccctgcactgtgtgtgtatgtgtgcatgcgtgtgtgcatgtgtgtgttaagcaagcaagttcctcctgggcttgattttgattttgtaatagtatccctggggcatgtttagatatgcttcttagtaaaggtttagggacattgacgaaagggaattctctcatttttaaaatgacgtatgtagagttatattgtaatgaggaatcagtgttcttttggctggcaataaaggcttactggaaattgaggcttgcaggcatagaattctccaaatattttgaatgtaaacacaaacacaaacacacacacacacacacacacacacacacacacacacacaccacactagagagcaccagtaaagaaaaaaaggttaattaaattacagtataaatgcatatttgttctcttttgttatcttaactaacttaaaaagcaattgtaaaaaaatgtagataatgtattgctttgcctataacataggaatgtgttatgtttgtcaataacagcacaagtaggtgagtgggaacaatggtgtgctgggaaaatgattccagatggttacttgatcaaagtataaatgaaggaaaccagaaatgataaatgggaaggttaatacaacaaaagctacaaatatatatttgctcccctttcttttctctgctctttaaaaagacctaaaatcatataaaggaagaattttaacaatgtattattgggttggtaatattgacagatatacaacaatagtactacaataagtaggaaaagggaatggaactattaaaataacatatctgtatttcactggaattaaaatgatatcaatctgaagctgattctggttagttaagatgtgttggtaggccctacaaaagacgctaagaaaatgactcaagaaaagtaaaaaaattgttaaagaaatttaaatgcattagtagaaaatattcactcaattcaaaagaaaacagtaagaaaggattagaggaataaaaaaccatgaaatttatggaaaacaataagtgtaatggtgaatgtaaatctatatcaataataacattaatgttaatagaatatacaatcaaaatgcacaaatgattagattggataaaaaataagatccaactgtatgctgtctaaaggaaataattttgattcaaaaacacaaatagaatgaaagtaaaaggatagaaaacattatgcaaatggcaaccataagaaaggtggaagggctatactaatatcagacaaaatagactttaaaacaaaaaaaggtactagagacaaggagagggactttatagagctaaaagggtcaatttgtcaggaagttatgagtgatcagaagtgttttatcagttttgagaaaccctttgccagtatttgttcacatctctcttaccccattttccttctctttttcttctgtaacttcacttgcttgtttattagatcttctccctaaatcctacctgtctctaatgcttttttctgtgttttcaattcttttttttcctttctctgcttcagtttgattgttttctgttacctgttttccaggtgatggatgctgtgtctaatgtgttattgaacccaactagttagttcttaattttagattttgtttttttttagttctggaatttccatttgatcctgttttcaccattttgaatataccgatgaaattacctagcctttcaattctttatgcatattcttcattttcatattaattgaacattaattgaattgtggttattttaaaatccttgttagttaagactaaaattgggatcacctatgggtctgtttctattggttatttattttcttttgttattttttgacatgtgaaggaatatttgaataaatgccagacattatttatttaaaaaatacagaaactctagattcctgagaaggctcactttcccctcttggcagagtggtggtcagttggcttacttcagtaaggaactgtgctgaatcatggctgcatgagggatgacctctggctcaagactgaccttgtgtagtttcatctaggatgttggtgtgttttgggaacgttcttttttatggatatcaaattctaatctttgtcatgtgagactgacaacagagctctgttttgttttgcagggtcttcccagttacgtttttgccttttgccacatacgggttccagttttcaatacatgttttggggaaaataatctgccatatgcttgaaacctcataattctccaccaaaactcttctgattccttttactcctgctgcagccctcttccagctgttgccctggattttgccctagactcttagcttcttgcccatattcaaattcatcaatacctccaggagaaaagcaactgcagaggccagttcacctctctgtttcttcccttataaagtattagtccattttgttcttgttgccttagcaactcttgtctttttcaaaagaaaatttttgtattccgtctggcttttctagctctggatgggagcactggtctttggacaagtggacaagtaatacatcctccctagaaggtaaagaatctttgtgtagtacatattttgaaatatctttctgtttattcatacaaatttgccatttagctgatatcagaatttgagggacatgatatttttccttaaaagcataaatgtattttttttgtctttttagcattttagagtttatcaagagtctgatttttatttattttgttgttaaacttaaaaaaaaatctgggtgtttaaaggcttatctgtttagtgaaaatactatatatttttccaggatatgtgtttatgtgggttatctttcagtgattttgaagagtttgtgataagctttatacactaagctttcttgacagtttctgtgtggttttcaattaagctctagatgtttgcttcttctctagttggagtgtcttcctgagaatacctgtgactcttaggttcaagctctctttcctttctccttacccgtaatcttcaccatccattttttttttttttggtcactttggtttttttgtactgcattttgaaaaatttatcaaattatttctgtttgattagattttaccaagtttaatcttatgcttcattgaatcaatttgcatttaaatcctactattgtgattttatctttttgaaaattatcctaccttgagtcttttttctctcttttctatgcatattagtcttttattcttagtcttttttttttctttgtatcttggctttctgcttctgtttcatagaagtcatgcattctaataagtatggcaaactaatggaaatttytcctttctttagcaaatcattttcagatatttgttatccttgtacatttttaaggtgatctttcctttcattttcattgcagtattttaaaaatcaactttagtgaggtatcatttacatttattaatatacacccattttaaatgaacacttcaatgccctttgtatatatccatatattcactaccacaatcaagataaggaatattttcacttcctcaaaaagtttcctatacttttttttgtagtcagttactccaacatcattctcatgcaaccacggatatgatttctatcattacagattagttctggctgttcaacaatttcataagaccagagccatctgctatgtacttttcttcctagcttcttttgctcagcttaacattattaaaatttattagtattgttatgcctatcaatagtttgcttctttttgtcacttagtaatattccattgtataacacgctgcgtgtatccattcttgtattgactgaatgtttgtgtacccccagaattcataactgaatccctaatccccattatgatggcatttggaggtgaggcctttgggaggtgattaggtttagatgagacaatgaggatggggctcccatggcggggtttagtgtgcttctaagaacagaaagagagcagagcactctcaatctctctctctttctccaccgcccacacccccaaaacacacactgtggctgtctgtaagtcaggaagaggacccttatcaagagcctgaccatgctggcaccctgatcttggacttcccagcctccagaactgggagacataaatgtctaagtttttttcacccaacctataacattttgttttatcagtctgaggagtctaagacaattctcctgttgattggactcttgagttttttctagtttgcaaccattatgaataaaactgctatgaacattcacgtatcagcctccttttcttcatgtgtatgtttaagtctttgtatatatttacagtaactgttaatgaagaccctgcttgctaattcaatcatttccatgttttctttgtccattccaattaactgatatttctcttggatatcagaagcattttcctgccattttgtatgtggcataatcttcatctgaatgctggacatttttgagtgtctggattttttcctccattcctttaaagattttggagtttttctgtgtcgggagggtaatttactttctggatcattttcatacttttgggatgtgttttcaagtttcttttgagtggatccagagtaacctttactccatggctattaagccttactcctaaggtgcacacattttggagtctctatgactgctccaaatgttcagtggtaactcttcattctaggttgtcagaactcagatacctcctgtactgcctgaggaagttgttcagcttccagcttccctgtaggtttttcctagaagccattctttgcctggttagtcctacgttgcctgttgttcaatgtctgaaagtagttgttacatatattttgtctagatttctagatgtttatgrtcggaagcctagtctggtactggtacatcatcatggctggaagcaaaaatcatattgtagtattttcttttttaatttttattttttgagtcagggtcrgggtctcactttgtcacctaggctagaatgtagtggtacaatcatagctcactaaaacgtcatactcctggcttaagtgatccttcctccccagcctgctgagtagctaggagtataggcactcaccatcaggcccagctgattcattgttttgttgttgttaaagatgggctcccattgtgttgtccaagctggtctttaactctcggcctcaagcaattctcccaccctggcttccaaaaatgctgggattgtaagcatgagccatcacacttggccattattgcattattttcaacagttatttaaaattcattttactatttgattattttattttattcactattcattattttattttattcaccattttcttagagtctatgtgaatggtttgctttgtaacacctttgtccttttggaggtgattgaaacctcttttcaaatacatagctaagacagaaaattaatttcttcctagtcttagtgaaattctcagtgacattcaatacttgtatgtcagctaacattactgagtttgactacatgaaacaatccaatccacaggtccagatctttgacactttgaataaatctactatgaaacttcatgactccttgtatgttctgcagtcagagatcttcatcttttcattcagaggataaatttattgctcttctttgagagttatgaaataagactctccctttctgtctttctggatagtgtagtccaaagatgttacatctagtattgcttcggcaagtttgacaccacgacggtaggtagaaggatggtagtttaagcagaaaatgggatcctactttaatttatacaaaaatatttatttagtacctattgtgcatcagacactcttctatgagctagagatacaaaaatacctgaaccttgcattccattgaatcaaaccactgcattacctaaccctgaaatgcataccatctttagctttttgaagttacgatagtcattttctcatctttattgtttaaagccatttgacttaagttttctgtacttgcaaacaaaggaatcctcagaatatttcactgggctgcatgctcacattgtagtttaccactgccagttccccatccctcttctaacaaaattcttgcctggtgatatttttgataagaatggtagctaacattaattgagcccttactatgtattgggtacttttctaaccactgtacatgcattgtatcatttagtcttccaaacaacccaatgaagtaagtactactattatcgcccttttactaccggggaactgtaaactttctcaaagctaccttgccagtaagcatggaggatttgaacttagcttgtctggtgggaaagtctgagttttcaaccacaacattcttttactaaacacttgcttttattcactggctgtattgtgaatatgttttcgtgcattcaaatatcctcttacaactatattaccattttgctccaacatattcaattatgtaggtaccatattatatttagcctacatctccttttttggcattattttcttctaatttttcacttgaataatgacattgctatgtacattcttgtatatgttactctttttttttttttttttgagacagagtctcactcttctgctcaggctggagtgtagtggtgtgatcttggctcgctgaaacctctgtctcccaggatcaagcgaatctcctgcctcagcctcctgagtagctggattacaggtgcatgccaccacacccagctactttttgtatttttagtagagacagggtttcaccatattggccaggctggtctcgaactcctgacctcatgatccrcccgcytcggcctcccaaagtgctaggattacaggcatgagccacagcacctggccatattactctttttagaaaaccagtctaattatttcttttctttttttttttttttttttttgagacagagtctctttctgtcatcaaaactggagtgaagtggcacagtcaccactcactgcagccttgacctcctgggcttaagcgatcctctcaccttagcctcctgagtaggtgggaccataggtgtgtaccactatacctggctaattaattttttttttttttttgtagagatggggtttctctatgttgcctagatttgtcttgaactcctgggatcaaggaatcctcccaccttaaccacccaaactgttggaatcatagacatgaaccactgtaccaggctactctaattatttctttagaaaaattcctagaagtagaatatctggaaccaatgaccagtctattttaagttcatgatggaatatgcaacgttgtcctccagaaaatattagtttacatttctaccataagtatatctttctcagtattttagtaagaaatgtggtaagcattaaaatttaaaccaggctgggtgtggtggctcatgcctgtaatgccagcactttgggaggccaaggtgggtggatcacgaggtcaggagttcaagaccagcctgaccaacatggtgaaaccctgtctctactaaaaatayaaaaattagccaggtgtggtggcacgcgcctgtgatcccagttactcaggaggttgaggcaggagaatcgcttgaaccccaggaggtggagatggcagtgagccgagattgtgccattgcactccagcctgggcaacagagcaagactccatcaaaaaaaaattaaaccagaaattccctttattcatttttagcccagatttatctgttcctgatcactttatttctcaaggctatcagtgcttatcattttttcctcttgggcagtatctatctgaattctgtatttttaacatgtattttgactcctcatgttcctagttttaaagaattagtctgtgaacttgctgtgggtttaaggttttttcctgagaccctgagacctcactaagattttcacttggcagggttaaagagtgaaataatcacctggatatcatggctgaaaatgctattggaaagtgaagaggaggttgcatgcagtggctcagtcctgtaatctcagcacttagggaggctgaggtgagaggatctcttgagctcaggagttcaagaccagcctggacaatgtagtgagacccactctctactaaaaatacaaaaaattagccgggtgtggtgggacatgcctgtggtctcagctattcaggaggctgaggatgaggcagaaggatcgcttgagtctgggaggttgaggctgcagtgaactgagatcctgccactgcactccaacctgggcaaacgagcaagaccttttctcaaaacacaaaacaaagaaagaagggagttgggttggaatcacttaatttgagaactcatttatatctcattaactagtttcctgtttttattttaaaacccagatatcacagtgaaatttaaactcatattcataaaggaaaacaatctgcaaagtccaatctagtttatatcattagtaagaataatagtatggtttaaataagatctatatatttttactaatattcgttctgctttcacaaatatattgccaygtgtagayctctccttcataccaagagttcagttggcaccatgaacagttcaaaacactaatacttgtgatcacagtattggttcttaattaaacgtacaattcccccccacacactatttatggattgctaaaacaatattttcacctttatctttggctgtcagatagcaagttggacagtgaagtagaactgacagaaatgaagataactacaaagttagcattgatttttgcctccccccctctgtcttttgagattgtttcttcacatttctcatatcttttctcctgacttatgaaaggcaccctttcttgctctaggcctttcattgttttgaaacataaaaaggaacatcaaagactttcatcgtgtgcgttttggatcttactctacgttgacaatatcgagaggttcacattcctactaagcctgtgggtttagttcagcaatgctccccatttttctctactgaccataacatttcaaccctgctggaatctttgaagatggttattgagtgactttagaatcatcctcggagttagaaaaccccagaaagcatcttttctttggtattttattctacatcttgaaaacagtaagaacaaatgcacttctctggggatataatgactaggaatggagaccatactaggaaaattgacatgaagagcaaaaagatccactcaaatagttcttttgcactatacaatgtgtcacaagttgcttcttaagaagaaagctagtcaaaatatagcttaccttttgtgtctcagatggctgggctttagaaattgagacactctggtcaaatatctagcttcagaaggtgttgtttacatcctcatcaattcatctattatttgcaattgtttgcatttcaggttttagaaataaaaaagtgttataagaattcactgtatacaaactgacttaaatgtttttataggcttagtcaaagcctgatttctttacaagattagttctaaatgaaaatagaaagagcttttgatccctcccaagggagtattcccagataatattattcatttactcttccttataaatgattttctctgcttataatttgtggtttatgttttcatacttgcagttggtaaaactgtccacgaaatcacttctgacaccaactgcaagtttgggggttcccacgaccaccctcacctctgacaccagctgtaagaatgagtgtctatgaggctactctcgggcttgataatttgctagactcactcacagaactcactaacagccattgtcctcatggttacagtttattgcagcaaaagaatatataccaaaatcagccaaaggaagagatgcatggggcagagaataggagaattcaaaacgttgagcatctagtcgtcctctcccagtgttaactgcacctggaatgatgtgtaacaatactcagttagtattgccaactatgtgtctgttgtcacatggcactatttaacactgagctgtggtgaccagagttttcagttgggtttcagacacatagaatggttggctaactcaatctccagcccctctggaggcagagctgatactgtgtaacccaaaacttctaccataaatcccattgctagawgatctgggatggcccaaggctcttagctaaactaagacagtcctgtcaggcagaacattctaagggttcagagattgtctcccaggatccaaggacaaaggtcagacctctctttgggcaagattaaattctgtattacacaataccagatgagcagctgtcttttgatggctgtaaatggatagtgaaggatattttcaatatattttgggtaggagtagtgatctgtcatttcaggaagattacaggagtgtagatttgtgtctggtaggatgagaaagccaccgtttgaacctgtagataattctgagaccactgataggaagcatttatcctttggccaatattaggttggttgccatcaagtgttagcagcatacaacaagcttaggttttctaaaatacaaaaagatccttactgagagcatattagaggaaactaattctgtggaaggagaagtatatttgcttcaggattaagaaaaaagcagcatcaattctacattccatttaagtacatttccatttgcttgagaaaacacatccattatttagttgcgaatcaatttttgagtgagcagtgaagaaagacttagacgagagtctttctgaaagcttttatgggtagaattctacaatagagacttgattgttcctcattgtttcctccagttccatgaggattctatgtcatctctcctaagttcccttttatctcccccattagatgagaaaatgtgcaccaggccatctcctgcactcttccccatcttggctaatcattgctccatctatccatttgctcaggccaaaacctatgtagatatctgtatcagttattattgttgtgtaataggctactgcagacttagtggcttaaaacaacacccctttgttagctcacaattctgtagttcagaagcccggacatggcctatcttgactctctgctcagggcctcacaaagccaaaatcagggtgtcagtctgctgcattcttatccagagctcagggcttttttccaggttcatccagattggcagaatttaattgcttgtggttgtggaattaaattttccattttcttgctggatatatgggctgaagtttactctgagctctttggggcttttctcaggtcctagttgtgtggatttctcaaaacctggcagcttccttttctgagcaggcaggatgatctttctccagtctgccaagacagactcttatataatgttgaataatcactagagtaaccatcctactacctttgtcacttaacacaacctaatcaaaggagtgactaacccttaatggttacaggtcctatctgtggccacagggagcgattaagcaggggttgggggttttgggacatctcagaattctgctcatcaccatgtctttgtattgtattacattattcttcttcttattttatagagacagggttttgccatgttgtccaggctggtctcaaactcctgaactcaagcgatccacccaccttggcctcccaaaatgttagtattataggcgtgtgtcaccacacctggattgtgttacgttatttaataaaataatcatgtatctctttgtaatattaaaaaagactttaaatgaataaaatctagaaagaaaaaaataaaccagagactttaaacattcaaataaatgggggaaaacaaagaagattttaaagtttaatacatgcaaaatgttaaggaaaaagaaaaagggaagcaaagaaattacatggttaaaaaataaaataagatggtagaaataaatcaaaatttatcaatagtgccataaatgtcaattgactaaacataccgtcagtagagattctttcattggatgaaagaatataatccaactacatgcagtttaaagagtgcccctgaactatggtgatacacaaggtttatccactaaattatttaactaatattgtttttgtttctaagggctcttcagggagaaaattaaagtctctgtgctcctgaagctcacgttatagggtgggatgttgatgaaaaatgaaaagctatgtaataatgtagagaatgatcaatgctactaagaatggagcaggacaaaggggtagagagtagtttggtgggtgggaaggcctggatcttttagctgggctgtttagggctgactctgagaagtagagatctgaatggtgtgatctgagagaccaaaatattatttaatagatgctcctttatcaactaagatggaccctacggttaaggtaacttttgttttcttaaccttagggtccatcttaattgataaagttcgattttcagaaatcagctaatatgacaaatttccaaattctaaggctacaagaaaaaaacacaatcttgctaaattccctaaaagtaggagctatcaggctcctcctaactctgatttacaacccagaccactacaactctgactggactgaggaccggccttacaaacattctttcctgataagcaaatgtagaccttaagccagcttcagccagatatagaggctgtgcacaaactgtctccatgtcctgtagttcacctttttgagatgcccaggtgggaaggactccctggcagaacttccaacagacctgtgcgctgggagcaacgcgcactcgggtggagtcttgggaagtttgccccgtttccagtggggaggagcctggaccccctcttcctgggtggaacctgggattcagcctgcggggcagcaagcaygctagcaggactctggctttgagaagggtccctttttccccctttttgcccaataaatttcattttttctcacccttcaaagtgtccgcgagcctaatctctgatggtcatgtgacaagaacccggctcttagctgaactaaggaaaatgtcctacaacatttcgacataaacagccaaattccattctattttaatactaaaaccctgcccaaagtgaacatgggacgtatattacatatatgtttatccattgcacatctgctcggctccacttgtaaatatgcatagcttttctccaaaacctgctgaatatgtatgactctattgagtaatatgtaccctgtgtggcataaaacccaacctgccctttccctccttgaagcaagagcaccttcaacccacaccagggactcttcctgttttgcaacctgataatgccaataaagctctcctttctactatttagccctcctggtggtcttttggaccagaatagattgagggaatgagccacgtgggtatctgcatgcagaataagtatgaagaccttgaattgggatgtgcttgtcatgcttgagtagcagcaggctgataaaaatgccactaaagcagagtgtgcaagggaggacaggtggggaaaggaagtggcaaggggcaggtgatgtaggtctttaacaattatgctaagtgaaataatccagacacagaaaaacaaatagcatgtggtctgtcttatatggtagaatctaaagaaggtgaatttgtagacggagagaattacagtggtgcttgtcaggcactgggtagcaggatggtttagagggaattggagagctgttggtcaaagggttcacgctttcwgttataagaacaacttctggggatctaatataccatatgagtggtgatggatgtactaattaagttgattatggtaaccattcacaacgtatatgtacatcaaatcattgttttgtacaccttgaacgtattcaatctttatcaattaaatattttaaaataaagaaatagatggggaaatatatttattgaacacctattttgtatcacacttggtacctagtttgggaacacaaaatggacaagacagatggggtcttgccaccttgaagcttttgctaaatcatgttccctatgaaatattacttactgttatgacactgaccaaggttctttccttgtcctgactctaatcaggctgcattcagcctttgtggtctcaaccttgggctttggtgcctattcttgtggattccagttgtagcaagaatcctgcttaaagtcagtttagccagaactccaactcttgatacttagtcaccctcattcttcaattaaattcctcatctctcatcatcccccaggtaatatctgatcaccttagcctgctctcagcaagaatcttgccaagttggtttggtcagaatcctgtctgatgtttcctgttagtaattttgcatccactgatccctgccctgctccttggctgtaaatccccacttttccttgtattctgaattgagcccagttctatagtcaggtctcttttctcctgttgcaataattcctgagtaaaatatatttgtcacgatttaactcctgccatctctggtattctttgacatcacaaatacataaacagcaacaacaacttggtctccttgaaaataatgggaacactcaagctcatctaggaccatggaaatagcttatttccttatatctttcccttcatcttctttaaaagctatgatctttcaagagctacatttagaatcttacatggctgggcaaattttgatctatcttttggtgaatgaatcactgactattcaaccatataacaacttctggctgcattgttacccagtagcgagagtttgccaaacagtactttgcatgacaaactacactgtatctgcccatatcccagctttccaagtaatctttggaaagtgtttattataccacaaagtttccaaatgtttatttcaattgcttaggggaaaaaggattggtttggagggcagtgaaattggttgtttttcctacccattttccatgtgtttcactccattaggtctgggcttgcaaagtttaggaaggggtttgtatgtcacaattcaactgcaaatagaacatagcaaattctcttgtgagtgttttggaaaatgtatgctgctctttcagtgcttcatcaggctgtgagagattgtgaaaccccacagctttcacagttttgcagtcagaagaaagccttttttgtttttattactgagcatttaaaactcacgagaaaaaatggaaaagccctagaataaaagcgtgttgagaggaggttcaaggcagtggcaagaatggctatcccagttttgggtcaaaacaagtgacaactaacaagacagagaacatatttatgcttgctactttaatgtttggtctcattatcttattagatatattgaacgatatttgtaaataggcagggaaaattgaagctttgtgtgtgtgcgtgtgcgtgtgtgtgtgtgttttattataggtagcttttatagcatgggatttctctcataacaggtagaggggcatggttccttccccattctgaagctttgtgttgtttttttgcttttttttctagtataaagagttcaattagggtaactctgccccttacctcatttgtcctggtgatacgtatgaaataacaccaatttgctagttagattaattgtgattagtgattagattaattgtgtgcactccacttcttcttgctcatcttccttttaggaggaaggctgcccttggaggggaaatgttccctmtgttcctttcgcccatgagaatgggcctgctgtcttgtccactactgcctgtgactggctcagaagtgggcctaatgctgggattcattgaatgtgccttcctacccagctgtatctttgtaaatattgatcttttagtttctatctttaatcttttatgtttatttttcaaatttttcagaagcttatttgggaagaagggtgctatttattggggccaattcagagacctaaactgtaactcaaagatcagttctatgaatatagaatacagaaatccaatcatcattgcatgagagagtgccaagttcaagccaatcagctaaaaggcaaatctcaatgttttgtctctcaaaacactctctgcataaagaccttggacatactagtttaaccaatagaaaagcttgtcagggccaggcatggttgctcggcctgtaatcccagcaatttgggaggccagcatcgaaggatcacttgaggccagaagttcaagactagccaaggcaacatggcaagacccgatctctacaataaattaaaaaaaatatattagtagggcatggtggcatgcgcctgtcatctcagttagtcaggaggttaagttgagaggatcacttgatcccaggagggtgaggcttctgtgggctgtgattatgccactgcactctagcttgagtaacagagcaagaccctatctctaaaacaaaacaaaacaaaacaaaacaaaacaaaacaaaacaaaacaaaacaaaaggctaatgagcattaaacctacagaaaggaatctgagcagaaaaagccaatggtcaatgatagggaatcctgatttcttactgacacccaaaacactaataaatctcttgatgatgtatgagttgctgttaccttgcacagcagtgagcagttctatatggcaattgctcagttagctctcaacttcctgaacagcagttgcagttattcagccttgctcttaagcgttagtctgcatgctgagttttagactagctaactgttagaaaaggtggatgctgagacctgcagagggaagttctcatgacacagatgtatgtgtctcaaaaactgttttctcccagtatgtagcctccagagagattccctgcctggcttggctctggggtgaaggaggctggtggttttcaattaaatgcttataaaatattttagaagaaacagggacagattgtaaattataaaaatgaccacagaagtatttccagccccatctgctcttccagaaccttgtcactccccatgaaaaggtagattttatctgggtagggctttcttactgccttgaggcaaaaatgtggttctgaaagtgatgctgggacataaaagaccgtaagatacttctctggctctttcttaggatgcggttccctggaaactgagccaccacacggtaacgaagctgtgaaaaaagaaatatatatattatatatatatagccatgcacggtggctcacacctgtaatcctagcactttgggaggccgaggtgagcagattacttgcagtcaggagttcgaggccagcctggccaacatggcgaaaccctatctctactaaaaatacaaaaattagccaggcatggtggcacacgcctgtagtcccagctactcaggagaggcagaggttacagtgagccgagattgtgccactactccagcctgggtgacacagcaagattctgtctcaaaaacaaacaaacaaacaaacaaataaacaatatagtaggttgcggtatttccaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggctggagtgcagtggcgtgatcttggctcactgcaacctctgcctcttgagttcaagtgatactcctgcctcagcctcctgagtagctgggtttacaggctcccaccaccatgtccagctaatttttgtatttttagtagagatgtggttttgccatgttggccaggctggtcttgatcacctgacctcgatgatccccccacctcggcctcccaaagtgctgggattacaggtgtgagccactgcacctggcctccactcacagtttttaacacagaagtttcaaaacttttgtaaagagaggtgccaggagaatcttttgttctaatatttggtcttagaccccagttccgtacacagggtttctaagacctttgtaataaccatagtgataggagcatctgacacaaagctcctaaatcccttggaatttcccaggtgataggagcctcttttgttctagtgagctgactcttggtgggctcctgggtgggtactggtcaccagaaaaaccaaggcatgcttagaagcttggaacttttagctccacatctcgtcctctgaagaggggagaggagctagagtctgagttaatcgatcaggcttaccagtggcatttagaaatggtgctagacccaacttctgaggagttggcttattggatacatgaggaaatgcaaaacaataagaaacatactaaacatacaatcctttggttattgttatttataacagcaaaaaatgaaagaaagtacagagctggactttgggtcctgcacaaagctcagttttggtttgaatgagcttcagctattagcctcaaagatgcttgcaaagggaaaaattaagcagggacaacagaaagtatctctggtcaccaagagggcagtcagcttggggaaagggacaagccaagagactactgaaacctgggggtattgcatgaagaagttatctcatcttgtggattgataccatcagctccctgaagaacctttactaacgtggattgtgagagtagctaatttgggggctgtgtcttttgttttgaatgctacagagtggaagcacatgcttgagttgattcaggatccacaggtcactattgaacaatccctctacacagggagttattcctatacagtatggctataaagtgtgtttatcctaaaagtgggattgtaactcccccataaatcccaagtggaacatctcagatgatgcagctgataggcttcatatgcaagctttatgaggagtggctattcgtttgctgaatatgcctgtaactgagcagcttggcttcaaatagcattttaaaactttgctttctgtcctcctttctctccaatctcaagatataactttgagacaaattgtatatgtgttacctgtcatcttgaaatacagccttggaatgtgctgtgaacatccactccttttcttttcctgttctatgctaccatgtctgatgcacgtttatttacctatatgcttgttaagcacacaccatactcacttatctggtcatatgtttccttagaagcttcaggggctggatcctgatatggaccagacacctccagccacaatggcaccagacgtttcaccagatggaacaataacttaagacaagccatcatattggtcatgccacctgatacctcctaggccccctgcctcttctgcattccaaaccttctctttaaaaccaacccccgtgttctcttcacaaattgaagagtggagatttttggaaagtattacaccccttcttccccttcctagcatggataataaaatctcactctctttttgtcacacttcactcttgttatattggcttctttttacaagctacaagcagccagacccttttgccaattacatgcccattatgaggcytatggaaaatgttgtgattaaaggagttccttttccatgggcaccccatgtgtacttctgcaaaatggaacaatagcttgaaaagccttaccagatttgctgtctcagcttcccctgtgggtcttactgatcaaggacattatagtaaataaaaaaaaaatgagagagacaaagaagagagtcatggacttgtcccagcagggtaggagtctttagatggttattgagaaactggatgaatgttgtggatattgatggtgttgaaacaaaagtattaatgcagcactattgaaggttagatgaaccaatgggactttctgtttgtctcccaacattgaaaggctccaacaagttttctccatttaccccagtttggagaaacttaaaaagtcagagattactcagaactggttggggtgacggttaagcaggttaatcaagattgatgargggccagggtctcctggccagacctcaggctggcaggggtcccaaggacatatgcacatgtgtagataaaatggtcagtggaaggagaagagacttttctgggactccttggtataggaggtcaatgcattgtaattccaaaagctgttggtgaagacttaacaggagttaaagttaagattgggggagtatatggagcttcagtggttggtggggttaacatggaagtttggaggacaattggaattcttgaaaaagctttatgtgagttggttgtgtcacctttacctgaatgtattattgggatggatattatgtctgactgcggattgcttcccctacctaatattgttattagaagttatgtaagtcttccctcaggccagttttctttgaatgtgctaaatgagaaccattagaactgcctgaatccacacaggtggttaatttaaaacaatatggagtacctgacagcagcagaggggggtgggggggtggggggcaaaaggacattcacactttaattaatgacatgctagatgcaggagtgctgatacaaaagaattttttgaacaacagccctgtgtggaaaaggaggatggctcatggagaacaaacagtagattattgaggcttaaatacataaatttgtacctcagtacaattttatagcctcagtaattttagtcatgatttcaatcatacaaaaagactgctactcagtgatcgaccttgcaaacattcttctctcagtctcagaaagtgccaaacactgtttgctcttatatgggaaggatcccagtttatgtatactrtgctaccatagggtcatctgaactcactggtttactgtcataatttggtcagaagggatttggatttgatgtaggtctcaagtgtaataatacactatattgatgatgagatgataatattggaaactaaagagccaggttaagactgagttgaatgcagcgatgactcacatgaccaaccaaggctgatcagtaaattcagcaaacatccaaggacttgcccacatggtaaaattcttaggaataacataggcaggagccacccagttccacaagtgactacaaataaactgctgttgttaatcacccccaagaccaaacaagacatctagcatttggttgttgtatttggagtttagagaatgcatattctacatctgaaaatattgctagcttctatacataagactacctgaaagaaaaccattttgagtggggacctgaacaaaagcagaccatgtctgaattacaaaaatcaatagctctctcaatgcctctgggccattatgatctccattcagatgattttggaagtgtctgctaccagtgctcatgcaaactgcagcttatggtaaaagcctgagcacctgggattccagatgctgccgccccatacacatcattcgagaggcaattactagcttgctgttgggctttaattgagacgacctcaatgactgaaggacataaaataatcatgaaacctgagatactgataatgtcttgggtgatgtcagagaaacactctaataagaaaggcagtgcccagaagagctccatgataaagtggaaatggtttatacagaagcatgctactggtggaatgcaaggaggcacctactgtatccataagtagctagcctcaggtcccctaggactgacttcagaatcactggaagaactgccagactctattgccatgtggaagtgccctatgaacagctcttgatgggctgacaaagaactgctgggtttatggatggcagttccaagatggatggacattatgttgtctggagatatgctgtattaagaccagaagatacaaaaactagtttaagaaattaagaacaaattggcttaatgggttgaattacatgccggttttttttttttttagcagtgatggaagagtttaacaatggtaaaagcccttatgtttgggtttttataaactcatgggcaatagccaatggtctggctatgtggtcagatagatggacaatggaaaactgggctattgaagggatggtcttatgtggtgtggccttatggaaattactatgggaaattaaggggagcattgaagaactacttacaggttcaggaggtgacttaaaccatcatatagacttattgatgctctcccatgaggtggtgagctgggtccatgaaataagtgaacatggtgtgggggttacagccatgcagaaatggactgaatgtagacatattcctcttcactctctgaagcacagaatgtcaccaagaactgtttcatctgtcaacaggagagatagagattgcagatggctacagagaagattctacatggggaaggccccacacatagctggtaagtggattatattagaccaatgccagtagcccctgggagctacaaatgggtcccagcaggaatagacacttactctggactggtagtaaatgcaaatgctgaaaatactatttaaagattggaacagacaatactgttccaatttggctcatcaagctacatttctttagcccaaggatgcactttacaacccatagtgtccaacagtgagcaaagaaatactacatcaaatggacatattatgttgcatatcatcctcagggtaatcgtttaatagagaattggaacaggcaattgaaatatttaccacctaaaacaagagaagacaaaggcatgagggacttgccttcatgagtgtgtgctcacactcaacatgggggaggataaaggaaggctccccctggatagatttctcacttttctgggggatctggcaaagcaggggtggaaatctccctcctgctgccagtgtggttatatgatttttcccatataatctcactttttttttgtcccagtaagaagcactggagcactgcctgatgccaagggtcctaggaccagggatgtgactgtgtacatcctcgtaagcaaggatgatttctaggcaagaargtgtaactaacttttaaacatctatgccagaagtcctaagggcctgatagtgtgaattcacatctgtgaatattgctgtgttgcctagggattgggctagccctgacatccccgataggacagttctgtacccaggtaacctgaccctatctgaatggaaatggactgaaagggaggcatttgttagactagcatcactgtcagcaatggccctcccaaagatggaaaactctgggtcagaataaatgacaaatggagagaaggagtaatagtagccgggggtaaaggaatacagtgcatacatgaggtatgcaacaagggaaatgcaacattgtcttaatacctcaggagagactcagatcaggatattatttcttagcacaattatgaacagatgtttggaacggtgaagctgtatgtttgctgagaccacccctgcttttggaacctttcaaggttgaacgacagcctgcaaacctgaaaggcatagttctgggagccattctggtcatatggtatgatgatgaattagactgttaatgaccaaatgggactctagtaacgtatcagtggtatcttttgacttctatattttaggctacatcaactacaaaggatatcttttggggaggaagttttgaggactgctttctactgagacttcaatctatgtggtgtatggctctcaacagactgatcactatggtaaccacaaaacctacaaaacctgatggtcaaatgcttagaaaggtccttggttatgatagaaaaaatatgatggtagcatgcccaacatagcatgcatttaggctatgcataaatacataccactcttgtttttgtggacagaaagctattaagcagtatagggaaaaacaatgggcctctggtaggattaaagaagttggcatcacattgtagatccaagttcccctggggaatgaccccactcgaaataaggaaggctgtgagaggccttatggcacactcaaattaaattacatctacctgtaaacaccaatcatctaactctagtgtggggacccaaaattttttgcaaaacatttatcctaactgcattcgygccattagtacgcaataccaatgatatgcatggtagattaaacaacactggctcctaagacagaaaagggcctcaggagagataggtgcaggtctaggtatcctgggacaagctgagtttactcttaatgtggagcagcattcggaggaaaaagatttattaactagaagagacagaatagaggaaattctcttcaaggaggaaggcaaaggatggagtcggggcggaaagataatgaggctttagcgaagtggatcaggccaactcaacaaacaatgctgggcactgctaacacccagcccaggggaaagggcttgtaccctgacccaataggacctcttgactattttaatacagatggaagctgaagtggccatggggcagtgacctgctattctggctgctgaggtccaagagacccacccatgggagtctgatggccttccaaacttatggaagttctctgagggcacttgtagttttacactgatagactatgaatgctctcacccacagcatagatcaaaatgaaatacatcctgcagtacagttggtagaaatgggaaccactctgaataccacctgtgtcctccctgcaagaaggaggtgggccttgctatctaataatacacaatggaaaccagcctcagtacaagcctgtgagatgaggtggggtggttctttttgtcctcaattaactagaaacccagatataactaaaccatggccaactgtaataatgcccttccttaataatatctgacaaatggacaagagtagattctgttgggaagacaagacaaattcctctgtaattcttacttatttgttcttttatgaaactgagttgtcccatgaccatacggtgatatggtgtcatactggtgctgtaagtaagattcaattacctggtataaataaatcttatgatactactgatattggtgactcaatgtaatgggagattgagttaaagtctctccaggatgtaatacttatggaaaataactgacttgaagagaaattggatttagctaaccatcagctgatttttctgctaaatagttctgcaaagcttattacaagacacaaatagcaatagaatgcacaaattagtacaagaatatgaaaatgttggttatgattttataggataaattagctgttcctttaaatctatccctactccaccctgggggttcagagagcttctgggtaataagtacatctgtgtgctgggtgagggaggcacacccctattccatgaggacagaaacctccataaacaggacccttctacaccttgccctgtgtatctctccgtttggctgttcatttgtatcctttaaaaaggactaagaaactcactcaaaaccgctcaactacatggaaactgaacaacctgctcctaaatgactactgggtacatagcgaaatgaaggcagaaataaagatgttctttgaaaccaacgagaaaaaagacacaacataccagaatctctgggacacattcaaagcagtgtggagagggaaatttatagcactaaatgcccacaagagaaagcaggaaagatctaaaatggacaccctaacatcacaattaaaagaactagagaagcaagagcaaacacattcagaagctagcagaaggcaagaaataactaagatcagagcagaactgaaggaaatagagacacaaaaaacccttcaaaaaatcaatgaatccaggagctggttttttgaaaagatcaacaaaatggatagaccactagcaagactaataaagaagtaaagagagaagaatcaagtagacacaataaaagatgataatgggaatatcaacaccaatcccacagaaatacaaactaccatcagagaatactataaacacctctacacaaataaactagaaaatctagaagaaatggataaatttctggacacatacaccctcccaagactaaaccaggaagaagttgaatctctgaatagaccaataacaggctctgaaattgaggcaataattaatagcttaccaaccaaaaaaagtccaggaccagatggattcacagccaaattctgccagaggtacaaggaggagctggtaccattccttctgaaactattccagtcaaaagaaaaagagggaatcctccctaactcattttatgaggccagcatcatcctgataccaaagcctggcagagacacaaccaaaaaagagaattttagaccaatatccttgatgaacatcaatgcaaaaatcctcaataaaatactggcaaaccgaatccagcagcacatcaaaaagctgatccaccatgatcaagtgggcttcatccctgggatgcaaggctggttcaacatacgaaaatcaataaacgtaatccagcatataaacagaaccaaagacaaaaaccacgtgattatctcaatagatgcagaaaagtcctttgacaaaattcaacaacacttcatgctaaaagctctcaataaattaggtatcgatgggacatatctcaaaataataagagctatctatgacaaacccacagccaatatcatactgaatgggcaaaaactggaagcattccctttgaaaactggcacgagacagggatgccctctctcaccactcctattcagcatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgatagtcaacttcagcaaagtatcaggatacaaaatcaatatgcaaaaatcacaagcattcttatacagcaataacagacaaacagagagccaaatgatgagtgaactcccattcacaattgcttcaaagagagtaaaatagctaggaatccaacttacaagggatgagaaggacctcttcagggagaactgcaaaccactgctcaatgaaataaaagaggatacaaacaaatggaagaaaattccatgctcatgggtaggaagaatcaatatcgtgaaaatggctatactgcccaaggtaatttacagattcaatgccatccccatcaagctaccaatgactgacttcacagaattggaaaaaactactttaaagttcatatggaaccaaaaaagagcctgcattgccaagtcaatcctaagtcaaaagaacaaagctggaggcatcacactacctgacttcaaactatattacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaagaaatggtgctgggaaaactggctagccatatggagaaagctgaaactggatcccttccttacaccttatacaaaaattaattcaagatggattaaagacttaaatgttagacctaaaaccattaaaaaccctagaagaaaacctaggcaataccattcaggacacaggcatgggcaaggacttcatgtctaaaacaccaaaagcaatggcaacaaaagccaaaattgacaaatgggatctaattaaattaaagagcttctgcacagcaaaagaaactaccatcagagtgaacaggcaacctacaacatgggagaaaaattttgcaatctactcatctgacaaagggctaatatccagaatctacaatgaactcaaacaaatttacaagaaaaaaacaaccccatcaaaagtgggtgaaggatatgaacagacacttctcaaaagaagacatttatgcagccaaaaaaaacgtgaaaaaatgctcatcatcactggccatcagagaaatgcaaatcaaaaccacaatgagataccatctcacaccagttagaatggcgatcattaaaaagtcaggaaacaacaggtgctggagagggtgtggagaaataggaagacttttacactgttggtgggrctgtaaactagttcaaccattgtggaagtcggtgtggcgattcctcagggatctagaactagaaataccatttgacccagccatcccattactgggtatatacccaaaggattagacatcatgctgctataaagacccatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccacatgttctcactcataggtgggaattgaacaatgagaacacacggacacaggaaggggaacatcacacaccagggactgttgtggggtgggaggagggggagggatagcattaggagatatacctaatgctaaatgacgagttaatgggttcagcacaccaacatggcatatgtatacatatgtaacaaacctgcatgttgtgcacatgtaccctaaaacttaaagtataataataattaaaaaataaataaataaataaaatgaactttgtaaaagcctttgtaataaattggtaatagtacgtaaaccattttcctgggctctgtaagctgctttagcaaattgtttaactcaggaggggattatgggaacctctgatttgtagtcaagctagacagaagttgtggggaacctgaggacctaccacttgtgattgaatctgaagttgggggcagtctggtggggctacagccttaacctgtgcagatactaattccagttagtgtcagagttgaattgaatcataggtcatctagctggtacaggagaattgtacagtgtgggaaaaaaaatccatatctgactacagtagtgtagagtgtgagtayagagaaaaacagttgatttttcctatacattttatgtcagaagtgaagcacgtattgagaatggtgtgagtatagaaggaaaagcagtttgtgtttctctatatacaagcccaggccacatggagagatatgtgcaggtattctagccgacaaccccagctgaggtctcagctgatagaatcaacctccaactataagtgagtaaaccttcaaatgcttccaggcctcagcctttgaaccccagccaatcctgggtggaacagagatgagctaacctaccgagcctgctgaaattgcagattatgcgaaaactaaatatagccgttattttaaaccactgcattatgaggtaattattatgcagccacacaaacaggaatggaacccattttattcaatgacagcttctgccactttgctgaagccttaatcatgaattatatggcaagaagtagatttacatttatgaayaggtcaagaggaaagaaatgaagtcttgttagaacaactgtgtttctggaaaaactttttctctggtaaaagtttcagcaattgtgttagtttctcgtggctgtcgtaatgttaccaccaatttggtggcttaaaacagcagaaatttatgctctcacagttctggaggccagaaatcagaaattggtatcactggtgacaccatgatgaacctggacaacattatggcaagtgaaacaaggcagacacagaaagataaatacaggctgatctcattcatatgtgaaatctcagaaagttgaacccataaaattagagagtaaaatggtagttaccagaggataggggaggggagtgaatagsgaaagggaagatatcgattaaaaggtacaaaatttcagctagacaggaggaatacacttagtgattcattgcacagaatggtgactataataaataataatgcattgtgtatttaaaaattgccaaaagagtagattctaaatgtttttaccacaaaaagggtaagtatggtaattagcttgatttgatcattccacaatgcaaatatatatcaaaacatcacattgtatctcataaatatatataaaattatttgttatctcaaaataaaataaaatttaaaaaataaatcagtatgactggtatgaaaccaaggtgctggcagggctgtggttcccctggaaattctagaagagaatccattctttgccttttccagcttctgtctgtggataccagaattccttggcttatgtctacatatcattccaatctttaagagtgccatcttcatatctctttcctctctcttcatatccttttttctgtgtgtcaaaccttcctctgccactctcttataagaatatatatgactgcatttagggcccactggataatccaggataatctccccatataaaaatccttaatttaatcacatcttcaaagatcctatttctctgtaaggtggcatgcacaggtgcctgagattaagacctaaataacttttgggagccaattttcagcctcacattgcaaatatttttccctttgtattattcaccactgtaacttttattattaaaatgttgaacattcttgcacacatacattgttaagaatatatttttaggaaatattgtgaacattattaagaataatacacataacccagatttattaatattttaagattttgccatatttgcttcaggatttttcttaaattagttaacactttatagaaagagctggagctgtatgtgtacctctttcttcttccttagaggtagccattatcctgactttgtcatttatgattcctatggatgtttatagcctatttctacatggaagaggagggaacattactctagatatcaaacctagacaaagatatcataaggaaagaaaactaaagatcaatatcttataaatatgaacacaaaaatcctcaataaaatactggcaaacaaattctagaaacatataaaaggaattatacaccatgggtaagtaggatttattccaggaatgcaaagttagtttggcatctgaaaattaattagtataatatattgtatcaatagaattaaaaggaaaatgtatatgatctcaatagatgcaataaaagcatttgtcataattcaatactttccaagaatttatacaccaycaacaacccattaacctaggaatggaagagaacttcctcaatttgataaagagcatttataaaaagcccacagctaacactgtacttaatggtgaaagactagattattttctcttaagatcagaaacaagactctctgactgcttctatttgacattgtactggtggttctagtcagggcaatgaggcaagaaaaagaaataaaatgctccgagattggaagggaagaaataaagctatctctacttgcagatgacatgatgttatgtacagaaaaatcttaagggatccaccaaaaactattaaagtgagttcagtaagcttgcaggatacaagatcaaaatgaaaatatcagttgtatttttatacacctgaaataaataagctgaaaatgaaattaaggaaacaattctatttgcagtagcaccaaaaataataaaatacttggaataagtttaacaaaagtgtgtaaaacatattatctgaaaactataaaacattattggagaaattaaagaggatctaaagaaatgaaaaaaatgttccatgttaatggatcagagggcttaatatggttaagatggcaatactctccaaactgacctacagatttaataatatccctataataacaccagctgatgtccatagaaattgacaagatcagtctcaaattcacataggattgcaagggactcaaaatagccaaaacagatttgaaaaagaacaaaatacggggacttacactttcaaatttctaaacttactacaaagtaataataatcaattggtgcttatgcaatatggtagtgacataaggctgggtatatatatcaatagaatagaactgagagttcaaaaataaacccatacatctatggtcatctgattttcaacaagagtatcaagaccattcaatggggaaggaacagtcttttcaagaaatggtgctgggataactggatagccatataaaacataatgaaattggatccttacctcatgccatatacaattcaattggatcaaagacttaaatgaaagtgctaaaactgtaaaatacttagaagaaaacataggagtaaatcttcataaccttggatttagaaaaggattctcacatatggcaccaaaagcacaaatagcaaaagaaagctagatgaatcagacctcattaaaaacgtttttgcttcatagcagcagtccccaaccctttttggcaccaggaagtggtttcatggaagacaatttttccacacactggtgggtgatgtgggggctggttttgagatgcaactattccacctcagatcatcaggcattagattctcgtaaggagtgcacaacctagatcccacacatgtgcagttcacaatagaggtcacactcctgtaagaatctaaggctggcactgwtctgacaggaggtggagctgagatggtaatgctcgcttgcccaccactcacctcctgctgtgaagcccgattcctaacaggccatggactagcatctagccatggcctgggggttggagaccccctgcttcaaaggacaccttcaagaaagtaaaaagacaggtcaaagaatgasagaatatgtttgcaaatcatatatctgataagggatttgtatctagaatatatacagagcatgtacaacccaataataaaaagacaacacaactaaaaatggacaaatattgaaaaccggaacaccacaaggatgcccactctcaccactcctattcagcatagtactggaaatcctagccagagcagtcaggcaagagaaagacataaaaggaacccaaataggaaaagaagagaaaagtcaaactatctctctttgttgacaatacaaccctgtacctagaaaaccctgaagactctgccaaaggcttgtggaactgataaatgacttcggtaaagtttcaggatacaaaatcaacatacaaaaatcagtagcatttctatacaccaataatagtcaagccgagagccaaatcaaacaggcaattccatttacagtagtcacacacacaaaaaacacctaggaatacatctaaccaaggaggtgaaagctctctatacagagaactacaaaacactggtgaaagaaatgagatgacacaaacaaatggaaaaacattccaagctcatatactggaaaaatcgatattgttaaaatggtcatactgcctaaagcaatctatagactcaacactattcctatcaaactaccaataacatttttcacagaattagaaaaaactattctacaatgcacatggaaccaagaaaaagcccaaataaccaaatcagtcctaagcaaaaagaacaaagctggaggcatcacattacctgacttcaaactatactataaggctacagcagccaaaacagcatagtacagaaatagacatatagaccaatggaacagaatagagaatctataaataaagccacacatcagcagccacctgatctttgacaaggtcaacaaaaaaaaggggaaaggactccctgttcaataaatggtgctgggatagctggctagccgtatgcagaagaatgaaactgtaacccttacctttcaccacatataaaaattaactcaagatggattgaagatttaaatataagacctcaaaatataaaaatcctagaagaaacctaggaaacaccattctagatataggtcttgagaaaatgtatgactaagtccttaaaagcaattgcaacagaaccaaaaattgacaagtgggacctaagtaaaagaaagagcttttgcacagcaaaataaactatcaacagagtaaacagacaacctgcagaatgggagcaaatattaaaactgcaatgatataccatctcacaccagccagaatggctgttattaacaagtcaaaaaactgatggtagtgaggccatggagaatagggaacacttatacactgttggtgggaaggtaaattagttcagctactgtggaaaacagtttgaagatttctcaaagaacctaaaacagaactagcattcaacctagcaatcccattactgggtatatacccaaagaaaagaaatcattctgccaaagacacaagcacttgtatgttcatcacagcactattcacaatatcaaagacctggaatcaacctaggtacccatcaaaagtggattggataaagaaaatgtggtacatgtacatgatggaatactatgcgccataaaaaagaacaagatcacgtgctttgcagcaacatggatgcagcaggaagccattatcctaaacaaattaatgcaggatcagaaaaccaaatattacatgttcttataagtgggagctaaacattagctgtatgtgaacatgaaaacaataaacaagggggactactggtggggaagggcaaaggttgaaaaactacctattggctactatgctcattacctaggtgatgggatcaatcatatcccaaacctcagcatcatgcaatatacctatgtaacaaacttgcatatgtatcccctgaatctaaaataaaagttgaaagtatataaaaaggatatattatctgattaaacatctctccaaaatagaatatacaagtgtcccataaatatatgaaaagatactcaatattattagttattagggaaatgcaaataaataacacaataagctactaatttgcatacattaggatggctacaatgaaaatgtcagataataacaaatgttgtcgaggatacacactgttatggtttgaatgtgtttgctccaaaattaaggtgtttaaacttaatggccaatgtgatgatattaagaaatagagcttttaagaggtgattaagccatgaggaatttgctccttgtgaatgtgattaaggcctttataaaagaggctccacatagcattcagttcatttgcccttctaccttccactatgtgaggacacagcgttcctctcttctggaggatgcagcaacaaggcactatcttggaagcagtgagcagccctcaccagacaacagaacctattattgcatttatcttggacttcccaacctctagaattatgaagaaataaatttctattatttatgaactatccagtctttggtattttgttatgacagcacaaatggactaaggcatggacaagcaggaattctatacactgctggtgggaatgtaaaatggtgtggctgctttgtaaaaacaatgtagcacttccttaaatgattacattcagagttaccatatgacccagcaattccattcccagatatatacccaagagagattaaaaacatattcacacaaaacttgaacctggaagtttatagcagtattcatcatagccagttcctcaactaaaatgtggaaacaacccaagtgtaagtgaatggataaatagataaacaaaatgtggtatattcgtaaagtgaaatattgccaggccataaaaagaaatgaagtacatactgatatacatactttcagatccaaacacaagtatgtgagaattctgttgttccagactttaccaccacttcacatcatcagacttaaatttttgcctctctgacggatgtgaaatgtatctgttttgtacttccttgactattaaggctgaatgtcttttcatgtttattgactatatgagtttttttttcttccataaatatcctgttcacatgttttaactatttctttttctgcattgtttgtcttttctaattgatttactggagtatttggagaccccaacctgggcactaggggttcacatagctccctgcttgtccttgtttctaggcctttttgtgaactacggtttttactgatgctccaaattcacattcaggcatagggttttaaaataaatgtgttaaactcatatctccaactcctttccctcatacacacaatagttttagaataacaatgccatgtgttctacaataataagagaagtgaaaattatttaagagcatttgccctattgtttttctaattctaaaagaaatacatatttaatatggaagagttataaaatagaaaaatcataaagaacaaaagttatttataatccartaacccatgtattatcaatgtgaacattttggaacatttgttattcttgaaaatggtttagatagtaaacttttgaatacaatgagcacctgtcccattatgtattttaaatgggagaataatgatgtgttctcagcttatataaaagtcccgaaccattcttcaaatattactaaaatattcttaagcatctatagaaaaattgactggaatttctgcaaacttaaagacattttaaacactgttgagttaacatttgctaaaatcataggggggtatatttgtatgttttatgaaacaatgttgcataacattggaaattaaaattgtcttttgcattgcaaagaacatgtactataatgtaaatcaaattattaaatatggttaggttgcataggaatgcaaataatatttagcaaaatgaaacaagtcaaagcaatttttaaacaaaatatttaattgtcaactgaatagctgcctgaatgtggtgggtaaagagaaatggaggacatagtctgttcctgtttgcggggtgaagggttggttggtggtggcttaagagacatgtgagtgaactggagatgggatgaataaaacagtaaatatattatgtttgttcttatttaaattcaagaaaccagatgttcaggcttctcttgttgcactcaagacatcagaagttggtgtctattttccataattcattaaagagaaatgtgcaacctcactcttagatttgcagtatctttattccagagaattctctttccttgatggagacctacacaatttcttttttgttcaatctatgaaattaggatcagccaggtggtcagcatgactaattttacttcttatacaagtagcattaagggaaatgaatgcctaggttttcattttctgcagggcagatgctggctagttaagcttgcctgtaaatcatagtttgtccataaactccagcatattctatttagaaccacagagcgaaaaactaataaatacatttaaaaatcttagtagacattaactccagagaggttcttaatttttaacttgatcaaaattttagctatgtcttagtggtttggttgaattwtaagcagatattgagaactcgcattgctttataaaatgcttgggccgcatgtggtggctcacgcctgtaatccmagcactttgggaggctgaggcaggcagatcacttgaggcgaggagttcaagacgagactggccaacatggcaaaaccctgtctctattaaaaatacaaaaattagctgggcgtggtggtgggcgcctgtaatcccagctactcgggaggctgaggcacgagaatcgcttgaacctgggaggcagaggttgtggtgagccgagatcatgccactgcactccagcctgggcaacagagcaagactgtatctaaaaaaaaaattcttaatatgctttataaaaatggacattccataaaatagttctgatttgccgaacaaaacctttttagtataaaacataaaggcgtgggtgcattataacaggtttctttttcaagcaaggtttagagtaaagagatacaaaataaatggatctatatctacgttgtgtggtaatactctaattcctacttactcttggattggggtcctgttgaattctgaagtcttggtggggaaatggtattgatgccacttggaaggaacaggtccagtaaaagttttaataggatggactgcattcctctttctataaaaacatacccccaggaaaagggatcaaggtccattaacctaatcaccatttccacactgtgagaagaaaataggctgttattttttattttttgccacagtgattagtttaagctctcacactctgggtttctgaggtctaatgtctgtttccatgggaacggcagtggcaggcagctgctaagttgttagacatctaataatctggggaagctcctgtctgaatgcaggccaagtttctccagcatcttgggtcatttagtcacaagtggctgtgcagcctgtagagacatcttggaatatagggagttgaaatacttgctatattgaaattatatatataatttttttattcatttaatggagaagcattgagtaagaagtgatttgaggccaggcatggtagctcatgcctgtcatcccagcgctttgggaggccaaggagggcggatcacttgaggtcaggagttcgagaccagcctggccaacgtggtgaaaccctgtctcttctaaaaatacaaaaattagtcaggactggtggtgtgtgcctatagtctgcactacttgggagactgaggcttgagaatcacttgaaccagggagacagaggttgcagtgagctgagatcatgccactgccctccagcctggccaacagagagagactctatcttaaaaaaaaaaaagttataaaaaasaagtgatttgaaaaagaaaaagggctttaggaaggacacagaatataaacaaatctcctgtcctcatgacacttaagatttatagggattcctaagtctcctgtactgcatactcaaaatgcagggtcctaagacttacaggaaatattatactcaaatgcactttcttcattcctgtcttgaccatctgtgctgaatcctcacctcttttcctattctgtgaactgggatgtataaacgaataagaaatgtaaatatcctggctgctaattccttgtaagtctagaaagtggttaggtatttgacttgtctcctctggttcttaccctggccattcttgttgctaagaaggaatgatgtctcctgcaaagagcccaccaaacacatttctaccctaagtagcctgctcaaaactcatcaaaagccctactaagaygttttgctgcactgaaccctttcattttatagtttcctcatttagaattccctttcacacgtccattcattcattcaacaaatattaagggtctactatgtgccaggcctggtagtaagaatttggtatagacataatattccttcaagaagcttaaagccaggcacggtggctcatgcctgtaatccccacactttgggaggccgaggtgggtggatcacttgagcccaggagtttgagaccagcctgggcaacattgtgagaccctgtctctataaaaaataaaacaattatctggatgtggtggcacatgcctgtagtcccagctactcaggaggcggaagtgggaggattacttgagcctggggaggcagaggttgcagtgagctgagattgtaccattatgctccagcctgggcggtagagccagaccccttttcaaaaaaaaaaaaaagcagcttagagcttgatgggaaaaagctattacaggaataaatgcaaaacttgttatacaataacaggctacgttatgtattatgaggtttctgtggaaaaagaataagggatataacctaatttatattggggttgggttcatagaggctattttctacagccaaaatccagatatagagtctaaaatacgtggagtgagatggacaagagaaagaaagtgtcttgaattggttttttcccccattgtctcacatctctttttgcctttgcagtcacatcaattgagcatctttatggtggcccatttgtgctctttcatcagtttatgtcttcggttgcttaacagattcctctttgaggaagctgagattatgggggagggtttgagagcagcgatataggcacttagcaagaaaataacaacctacaggagcctgtgtgttataggagccttacagacagcaagggtgcataaagtcaatgttgagatggctaaggcaggcttcattgagaggaaaggacataggctcggctaagaaatttcttctctatccactgttatgttctgaaccagcagctatcaggtccagaggttttctagctgtaccctcttctctcccctgtggcagggcagatgtagtatccagggtggcctggctgcaggtcaccaatttagaactcatatgatggtccttggcaggtgcatggcaacgtaatccattcaatcacattgcacagtgataagtcactgcatgtgcgacagcagagaatgagccccgcctgggaaatagcctgtatctttccacttgtcctgactgattaacaatttatgctgcatgagtagaaaataattttgacctcattcactttattgcttgtgaaatcatggcagtatccatagactttttgcttaaacatttatattagtaggcatttttgtgttttcacatggctgcatgaaatgaacaggcacttttctaatatgaacatacagtgaatgaattaataactgtatgtttctaagagccacatttctgttagaactagccatataaggcatatgactaatgaattcagatatttaatattgaagtttaggaaaatgtcatttccactgggctgagaattagagtcaggagcaaatcttyctatctccctctyctacacattcattcattcagcattgtgtgcctattatatgtcaagatagtataatgtatatatttaatattatatatagtatagtataatacatattggcacataaatatgttttttatatatatataatcatcgayagtaacatgtttataggcaatagcaattcaatgtggcaagttttatgacaaggccatacacaggatgctatggagcatggaaaggaaggagtccctgagaacatgtcatcgaaactgacttcaaatggagatgtaggtatgagctggttgttagaaacggaatgtttgtgtcaccccgaaattcttgtgttgaaaccctaacccctagtgtggctacatttagagatggggcctctaaggaagtaattaagtttaaatgaggtcatgggagtggggccccaattcaactggattagtgtcctcataagaagagacatcgaaagccagctctctccctctctgaacatacacacaaacacgaggccatgtgaagacatagcaagaaggcagctgtctgcaagctgggaagagagccctcaccagaaactaaatttaccagaatcttggagttttagcttctgaactgtaaggaaataaatgtctgctgcttaagccaccaagcctgtggtattttgttatggtagccttagcaggctaatacagtggtaaactctgcatatggaggagttgaaaaagagagagtagatggcaatttgggcagaaggggaattacctgcaaatgttcaagggagtggagataattcttcttaaactgtttatcagtccttcaggagataagttaacaacagaggataattatcccagagarctggtttctggcaaatgtctgaagggcatggtaggtcataaaatacccactggtggtattttatattctgaaaaccattttaatctacctttcatgacctggatgcttcagcctcctgtgcttcctcagaatttgataactgacccatgagacaaaaactgatcktttatctagaatcctctagattccagtacaactcagcagctgtgaagcctctaaatttgcaacttgctttcttttaaactcagtagaatccctcagccagaaccaatcctcatgccaattttagaactgttcgatattcccaagaaaagaaaatggctggtgattgtcaactctcttaagaaagtctcttattttgggggggtggggtgagggggtgggggatggactctcactgtgtcacccaggctggagtgcagtggtgtgatcttagctcactgcaaactccgcctccgggttcaagtgattctcctgtctcagcctcccaagtagctgggactacaggcacacgccaccatgccctgctaatttttgcatttttagtagggacagggtttcaccatattggccaggctggtctggaactcctgaccttgtgatctgcccacctcggcctcccaaagtgctgggattacagctgtgagccaccgcgcccagctggaaatgttcttttgactctgaaattttagttcatcgagtccwcattgacttcacagctctctggtatctttaagtgtattatttttgtaatttatatgcttttttttcctggttactagcaggaacattgatccaccataaccaatttcatgtttctgagaagtgaagctcattttctgttaaagagaaagagagacatgaattccaaaacaggtaaaggtgtctataaaccagtaagtttattttagataccaagcaaaattctagaacttattatttataaggcagatggagagttattataaagggcacagtaaaaaatgtctaacataggattatcgagagcatatcatcactaaatagttctattttttttgacaaggctacagaaaaatagataatgtctatctgaaattcagaaagacatttgacaaagtttttcataatatccttattgccaatataacgagatgtgaagttaatactaatacgttcagatggatttagagtcaaaagattttattttataactttttaaagagaacagtgtgagtttgaagacatgtttctgtgagtggagtacaaagcttgttatcaaggaaactgggtggattttaatcaatgagtttgatagagacagagcacacagatcatgtaaagttggagagaatgccagtaaattgaaagacagaatcaagaaccaaggtatcttctgtaagctgcaacaaataacacttaatgggtattaatgtcatatcctacatttggataaaataaaaactgttaaaatgcaggctgagaaagacatggcttaataagaatatgtgttttaaaaagccttgggaagtattgttggcttgagctcagaatgagtcaacagggtgacatggccagcaagaaggccagtgggatttatagcaatgctgagaagggcagagggtgcagattgaatatattgcactggtgagtgcattatcctgaatactgcatggacgcgtgctgttgcattctgctctgagcatcatactttaggaaggaggaccatatatgaagcttgccagaggaaagtaactaggatataaagcatgagggaatgtaaagacatgtcaggaaaagagttgaaggataagagagtgtctaacttgggaaagagaggctttggaagatggaagaggtatcttccactgcataagggattgctttgttattgaggtcagagctaggacagaaatatagagaaaaaggttttattgctaaagtgcagaggaacattttcaaaatagtgataggtatgtaaattttgaattttgaatgagaccacttagcgtagtgatgacgatttaggaatttttttttttttttttttttttgagacggagtctcgctctgtcgcccaggctggagtgcagtggcgggatcttggctcactgcaagctccgcctcccgggttaacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggactacaggcgtgagccaccgcgcccggcccgatttaggaattttaaatcaggaaaaaatttaatattggaccctcttgccacttacaagctctatgattttacctaatcttttggattctcagttttttaaatctttaaaatgagaataatagtactgtttgttaagggtcattaggtgatcaaaggaaataattcatataaagtgcttgccatggtgaatcacacatttctatatgcttaatatgtatgaactatgtttaagttactgagatgtggtcagaaagaaaagcaagcacctggctgggcatggtggctcacgcctgtaatctcagcactttgggaggctgaggagggaggatcacttgaggccgggaaattgagaccagcctgggcaacatagcaagaccccatttaaataatatataaaaagaaaagcacttgccccttacattggcaatagttttattgcaggaagtaggaaactaaaccccaactcagaatttagacttgctgccagaaaggtaggtgccaggggagctgatgtaatcaagtgtcaccaattagagtctacagatcatgaaaagtaattctaggagattttcaaatgccttttttaacctagatcttctgcttggatgaattcatactatgaatttaggaaacatcaattcatttattccttctaggtggccagcattttaacaaaattacacatgtgtatacaagcatgcatcctggatttggtgagcacacataatttcaaatattctactctttgttccttaacatacattatcgttttaagattgatttggctggaaaatacaaccacagtttatgtatgtcacattctttttttttttttttttttttttttgagacagagtctctctctgtcgctgccaggctggagtgcaatggtgcaatctcagctcactgcaacctccggctcccgggttcaagcaattctcctgcctcaacctactgagtagctgggactacaggtgccaccatgcctggctaatttttgtatttttagtagagatgggggtttcaccatgttggccaggatggtctcgatctcttggcctcatgattcgcccgccttgcctcccaaagtgctgggattacaggcatgagccaccgtgcccagcctatgtcacattcttgtggtactgagattgtcaaaattcttttctgttaagaagcatggttcaaacctactgtgaggtactattttgcactcacaagttctgcaaagattgatgtaataaatggaaaggatatagggcaatggtaacttgaaactgctgttgggagagtaaattggaatattcattgttttactgctctaaatgttctcatcacacacaaaaaataagtatgtaaggtgatagatatggtaattattgtgatttaattgttctacaatgtatactatatcaacacattgcacaccataaatatatacaacatacatttgtcaattataaaagaaaaatattggcaggaaatattgtgtatagaatgatatatacaatatgattctacttatataataagttagttataaatcaatagttatgcctatgggttttaaaatatggagccaagacttatgtcttgtcttttttataatagccatcctaatagatggaaggtgatatctcattatgattttgatttaagttttcctgatgaattgtgatgttgagcattttttcatatacctgtgggccattggtatgtcttctttttgagaaagggctcagatcctctgcccattttttaatcaggttatttaatttttgctattaattctatacattctattagtttcttttatattttggatattaactccttatcagacatacggtttagaaatattttcttccattagtaagttgattcttcactctgttgattgcttcctttgatgttcagaagccttttagtttgatgtagtccactttatttttgtttttgttgcctgtgcttttggggttatatccaaagaaaacataacccagtccaacatcaggaagatttttccctgtgttttcttctgggagttttatggtttcaggtcttatgtttatatctttaatttattttgtgctaatttttgaatatgatttaacataaggattcaattttgtttttttgcatgtggatatccagttttcccaatgccatttattggagcaattatacttgttccattgtatattcttgctactattgtcaaagattggttgactgtatatatgtgggtttatttctgggctctcacttttctaaaactgggtatgataagacctaggtaactaagacggttgggtgagcctgaaagaagggaaagattgccttaggttaggccttatagcttaagaggcaaaaggaagtctcaagtctcctgtttgcttcagcccattaaccaggtttggagatcatacagaaaattaaggtttaagtgctaactagcagtgaaatgtaataaaaaactagttatgactctactgtggttttaaatggataaatgagatcgtgagtccaaasattcagaaactctgatactgttcatattgagagatttaactaaaaataagtttctgctggagagaagaatgaaaggtaagtacagaggaaggcaaggtacaaaggagattttctgagtccagtcagggttagcgtggagaccctgtgcacttggggaaatggaaaaagtggcaataaagagcaaattgtagatagaagcaatgaaggcccaaactggtaatgtcacacttttgctttgagcaggctggtaatgatttccccaggaaactcaactatgcaaataagaaagcttggaagtatgacttaacgattaatgaagctcacactactttgttcaatggaaaatttgttcttgtctaaatgtccagakagtaacttggttctttttctccagggttatgcagaacagaggagacgcttttctgccagctggaaggggtagcaggtggggtaatggattcccagcttgccagcggctgagattctaattagaatcttccttctggcttttagcaagcagctttcacttcatagtgtccttagagaagaaagttccatattcagcaagaaactgccctatttaaatgtataaaatctttttgtgtttgggctataaagcaagtggtcttcaaggttcatggcaagtatatcgtgtaatataaaaagcatcattagctcatgaaaatgctatttaaaaatgcaagtttgccttaggtaataaagttgaagaaagtagtctggaaatttaagacagaattgggaaacttaaaaatttagattttttagtttatatattgtatggattttaatatacacagatgaatggtgaagctggtagaaggagaaagaaaagagagatatggaggtgagggagggtgaaaatgtgcaatagatgatgacagtgttggagaaggcagaggtttttgccataaagaatctctagctgggatcacttgaggccaggagtttgagaccagcttgggcaacaaagtaagaccccagctctataaataaataaataagtaaataaataartaaataaataaataaataaataaatcagctgggcatggtggtgtgcatctgtagtcccaactactcaggaggctgaggcagaaggatcccttgagcctaggagttcaaggctgcagtgagctatgatgtgccactgcactccagcctggggaacagagcaagatcctgtcttttaaagaggaagagagagagactgactccattgggctttttctttttcacgttaaataaaatttaagggtttagttgtttagcctgtactgccttctcctggttggtcttggattagcagctcagatgtaacaaaagtgaactgtgtgaatggacccaactgtaacacagacgttatgtgccagattatgctgcctgcctgttgcagtttaccacggtgctggtaatatatccaggtcccattgggctggcttcaggccgtgatggtctttttttcatgagccttcctattgtgatactatgcatatattagtaagacgtcttaagtagaatacctattccaaaatggaatgaggcacatgtgtgcatactgaggtgcctgtgagttgcttacttctaaaagagagaggttacacaaaatcttaagcccttgtaatgtacttaatcttgtaaatgtgctatgggaacatttattgcaggcctccagagttgactttaatttttcttttatgacctgccaggagtagagtggagagattaaactatagcttccagaatcacagacaaatctgagttcgaagaaaaggtgatcctttctcagtgagaattctcttgcttaatagtcagagagattttgggaaattctgagagtgatgcctataaagtgaaagaaaaggaggagactgagaaaaaggaaacagaaaagcaaagttattgatttttgagcaggtaaaaccgaaaaactcattctatcaattatctatctgtctgtctgtctgtctgtctatctatctatctatctatctatctatctatctatctatctatctatcatctattgtgaaaggaactgctcagggaaaacttgcctcccatttctattcaaagtcatccttctgctcactgcgatagatgcatatctgattgtctcctttggaaaggctaatcagaaactcaaaagaatgcagccttcatctcttgcttatctgtggcctggaacccccgtccctgctttgagtcttcctgcctttgcttcaagttgtctggcctttccagaccaaaccaatgtacttcttacatatattgattgatgtctcatgtctctctaaaatgtataaaactaagttgtgccccgaccaccttgggcacatgccgtcaggacttcctgtgactgtgtcatgggcacgtcctcaaccttggcaaaataaactctctaaattaactgagacctttctcaaattttgggggctcacactatctatctatctatctatctatctatctatctatctatctatctatcatctatctcctacctatcatttacccatccatcgtctaccagttatctatatatctatctcattatgctgccagaaattgtataatattgggaacctatctttaaggaacttaaaaagatgaaaaagaatcaggaaatgctgatacaaaagaaataaatagagaatgaggagcagtgctggatcctggctctggctttctgttaagagtgtctgtgccttcagaagtgctggagcaggaagggttcatggacgtggctgggtcataagtaaaagtctatgtccaaatggtggaaacttgggaggtctaaccagtcaagaattgtaagcagctgtaggaaacaatacaagtgaagaccgaataagagctaagtaaaaacttggaaaaagcccctgtaatcccagcactttgggaggctgaggcaggcagatcacaaggtcaagagattgagaccatcctggccattatgatgaaactctgtctctactaaaaatacaaaaattagctgggtgtggtggcgtgtgcctgtagtcccagctacttgggaggctgaagcaggacagtcgcttgaacctgggaggcggaggttgcagtgagctgagatcgcgccactgtactccagcctggtgactgagactccgtttcaaaacaaaaacaaaacaaaacaaacctggaaaaagaaaaaaaaaaaaacagaagagggaatcagaaagttaatgtctgatcatatagggaagaggccagaggagcagcagggaaatcaatctgggttgaatctggcagaaaatgcatacagagagagaactcagcatgggagtttcttgtattttcaaatgacttctaattcctggttactccatgcacagaggttgtactcctggagagcttaaaggtaacaaatagctttgatggaatgtggctgcaaagatattaaccttcctacagaagagagattagcagcagacatgtgcctattgtgtgtgtgtgtgtgtgtgtgtgtgtataaaatcagtatgttcaaataaactgtctgggttgctgctttggtttgtgctaattattttgttttcaaagttttaggaaagaactccatttatattgttttaaagaaaaaacaaagattgactgaggtaaacttggagtaagtataggcataatcaaatagggtcccctagatcaaagctcaagcctgctggtttatcaatgagatgtctttgctaaagagttgattttggatcaggggctatgttcatttaataaattacaagtgtgaaaaagtcacagagatactataaagtgatctgattatttaatttttggaatataaagatatgggggagacttgtctcttgtttattataacagagcctagaattgaataaataccaactagtgatggtaacgtgaaaatcttgatcactgcagagattaaaaaaaccaaatctcatagctttacccagaggcctaataagggctaaaataactaattaaaaaaatgaataaaagccaagccaaaccgcgagaggatgatctaagttaaaatacgtgaccaggcaggttgcttcagtcgtagtagaaatattttaataagctaggagcaagatgaatatggagtattaataattgtaattttctttcatagttaagatatcagaaaccagtgagatatctcatagcctgtaaaagcagagcctctaattttaagagccaatttattttactataatttgagatgctggaaagacttttgagattgttatttaaatgccgtttgctattaaactgtggttagaaaatctgctcagccaaaatgatgctgaaagagcattaagtttatgagtcacaaaagccagagtaattctaattactttcctgaacttcagtacaatagagatgtttaatatgcaatgggacactcctttaaaattgttgcaagacaggtgatmggagtcttggcttctctccccaccttgattatcagtgaagtaaaggttaggtgcggtattgtattgtgtgttttcatcttaaagtttcttcttctgcagaatgggttaatgatggaaacatttgggtattgtggtgcacagagtgggttctcgtgtctcttcagagcaaagtcctcttatacatcatcatgagcctcataatgacgtttcggtcaatgacaactgcatatatgatggtggtcccctaagattacaatggaacagaatgcatagctgaagaagagccaagagaaaaggaaattgcaggagaagaaaaagaagaaaattcacagtgaagggtttagcagaagcttttgcagacctcaacaagcttcttaaaaatttgaaaatatggactccaacaccaaaagattttcattaatagagagaaatcttcagggtgcattatctgctcccaggcagataatctatgatgaaaaaaagaaacaaactaagaaaccatgatgaacatattcctgaaaaaagtgacaccttctcaggaagagcctcaggcaggtctttcaggagtatccagaagaaggcttgttatcacaggagatggcagcaccatgtgtgttttaacccctggagaccgtccagcaggacaagatgtggaggcagaaggcagtgctgttgatgatcctgaccttgtatggggttaggctaatgtgtgtgtttgtgtcttagtttttaacaaaaacgtttaaaaagtaaaggaaaaaaaatcttaaaaacagaaaagagcttatagaataaggttataaagaaagaaaatatttttgcacagctgtacggygtgtttatgtgttattacaagagtaaaaaggtttagaaaatttaaaaattgataaagttgaaaagttacagtaaactgagtttaatttgttatttaagaaagaaaaatattttctataaatctagtctagcctaagggtatagtgtttataaagtatacagtagtgtacagtcaagtcctaggctttacattcactcaccactctgtcactgactcacccagagcaacttccagtcttgtaacctccattcatggtaagtggcctatacaagtgtactattttttatcttttactctgtatttttactgtaccttttctatgtttagttatgtttagattcacaaatatttcccattttgttgtaattgcctacagtattcagtacagtaacatgctgtaccagtttgtagcctaggagcaatagactctaccatatagcctacatctgcaataggctacactatctaggtttgtgtaagttcactctatgatgttcacccaatgaagaaatcacccgagacacatttctcagaacgtatccctgtcattaagtgaaacatgactgtagttaagtgaggttataatggtttagaatgggtcctaaatccaatgactgatgtctttttaataggccagtaaaaacagagagagacacagaggtccacataggaacaccatgtgaagatggtggaagagattgaaatgatgcatctacaagccaaggaatgccaagacttatggtagttgtattattattagaattattttttatgctattattataattggtagtgtttcatacagtatttattgacctgacattaatatttgaccagttttattttttttctttcactgaaaaacctaggtccattcttctttttttcaagcatcattttgtatgagtatgttttagttgcttctattgtatatttaagacttgactccccaagaaataggaacacttttacaccgttggtaggagtgtaaattagttcaaccattggggaagacagtgtggtgattcttcaaggatctagaaccagaaataccatttgacccagcaatcccattactgggtatatgcccagaggattataaattctataaagacacatgcacatgtatgtttattgcagcactattcacaataacaaagacttggaaccaacccaaatgcccatcaatgatagactggttaaagaaaatgtggcacatatataccatggaatactatgtagccataaaaaagaatgagttcatatcctttgcagggacatagatgaagctggaagccatcattctcagcaaactaacacaggaacagaaaaccaaacactgcactttctcactcataagtgggaggtgaacaataagaacacatggacacacggaggggaatatcacacacaggggcctgtcggggggtggagagaaaggggaagggcattaggacaaaaacctaatacacacagggcttaaaacctagacgatggtttgataggtgcagcaaaccaccatggcacatgtatacctatgttacaaacctgcacattctgcacatgtttcccagaacttaaagtaaaataataaaaaaagacctgactccccattcccccaattttgtaatcaaataagagagtatttacctctttattgggaaatatatataatgcccatttttctaatatcaaagttgcagcttaaatatatatatgtaatacatatatttatattagaaatatagttgtactttacacacacacacacacacacacacacatacacacacacacatatattggagataagagtcttgatcaggctggactcaagcactcccgcactcaagttatcctcctgcctcagcctcctgagtagctgggactataggtgtgaaccactgcaccctgcttatagctgataatttaatatgaatttatcttagctaatctgcaaagaccctattgccaaataaggtcacattctgaggtttgggatagacataaattttttatatttgctatagttagtgttctttttttaatttatattaaataaatgcttctgttttgaagcatttatattattaaatgaatattatttatttattttttataaaataaatttatatattaaataaatgcttccttaaagtttctatatttcctgtctggcttccttgttgttatattgctaaacttgtttgggaaacatattttgtttccattccatgggtggttactcaaaagttttttcaactatgtttaacgtgatgttccaagggtttttttggggagtgtttccccttgacataagaagtttaggatacttttatttttacttctccagtaccacaacattcactcccttctctgaattctgtcttttacactgatactgttttgtaatttagatactgataattttactaacaatattatttttatattatatatcttctctttggggacatattttgctttgcattcaattttatatcaagacattaaaatttttcttagctttaatatgtatttttaactgatcttaaaggattctgttaattctgttctctcaatcagttggagtatatctttgagtaatttccttaaagagaagtatgtttcctgagctgttgcacagctgacttttttttttcttttttactttgaacttgaataatagcttgaattttgctccatttggttctggtgttttgtgttttgtttttatttttttagagacagagtctttctgtgttgcccaggctggagtacagtggcatgatcatagctcactgtaaccttgaactcccagactcaagtgtccctcctgcctcagcctatggaatacatccagctaattaattttgcttttgtagaggtagggtctcactatgttttccaggctggtcttgaactccaggcctcaagtaatcttcacgtttccgcttcccaaagtgatggttagaggtagctaaataaagaattctatcactgtcattattactattcaaaaatattacgacaatgtcattaggtataacatttcttcttattgatttttcttgggatagaaatcttttttgatttatatatactggatttctgtaaatttagattttcttctaatgattcacttattatatttcttgctggcttcttcagaaacaaatattatccatatgatgtctcctttttcttcatcttctatattgtccatattttctccaattattttaatctgtttatacctttattctatgctgacatatcttcttgagtttcacttttacagttttgatttgaatttcttctccatctatttttttccattaccctccatatcgattaagttacattaaattaagaaattatttctcttacgtttttcttgggttccttgtttttatgtttttcatatctcaactaatctttcttattgcttataaaaatcttgttctattatcaccttattcatgaaaaaactcaaaattctgttttctttagataatagcatatagtttcctaaaattcccttctgaaaacttttagagatctactttttggaagcaactctatttaacttaccccattatatttcttatttgttataattttatatttttccagtcaaagattggcaaaatatatttttgacaagcaaagattctctatacttatttttcattagaatgggtgtgtgtgtggcccttggtcacattctgtctattgatgtgatcttggaatttgtactttaaatccataattgaaaggctagttggtttgtgttgttcccagtttaattctcatttgtaagcaaatatcctcctagtgctcctttgttctagtgcagttttatcttctgagtgctggaaaacctctacttcttgagaagtatgtgttgttactaggatgttgttttttccctctgcatatattgctgtcttcttaatggaaagtacacctctctgaaaactctattctctattttctgcccatttgttctctggacttcatagaaccttcttctatgtggaaagatagtgggaaaaaaaatcatgcagtggtttgtatgaaaaactacaccttttgcctaacagcaatatctaagatgtggagagaaataattaacctgttttctggctagtacaggtgttggatccttgagtatggggacacatttacattttttgtgcatctgtttctatttcatgtaatgatactgtgtgaagtcaggaatagaattctaagtaggattttcctcaatttaacttctactgtcttataattaatttccatttatcctgcattttggctttgaattatctgtcagtgttagatttcagagtttttgagagcttcttttttttttttcctcttgggtacgcctttgtaagtatttaaaggttagttggaaagaatggtttggagaatgctacccagacactcttttggattttaagtctctctactgattcaaaatgctatttcagtaatctcagttgtaaatgtttactatttatttagagacaaggtcttgctctgtcattcaggctggagtgcaatgatgtgatcatagctcactgcagccttgaacttctaggatcaggtgatcctcctgcctcagcctcctgagtagctaggactacaggtgtgcaccactgagtgtggctaattttgtttattttttgtagagatggggtctctgtcacccagatgggtgtacaatggcacaatcatagctcactgcagctttaaactcccaggctcaagctaccctcctactctggcctcctttgtagctgttactatcgtgcacaccaccatgcacagctaagtttttctatttttttgtacagacaggctttcaccatgttgcccaagttgatctcaaaatcctaggctcaagcgatcctcttgccttggcctcccaaagtgctgggattataggcatgagccatggtgcctgtcttattcttttactgttgaggaaaatatcttcaaaaagctcatttaagaatgaaacatagtgtgagaattcatttttgagttgtagcatgtctaagaaggtatagaatttttggatagcatatttttttccggcagagttctagaaatgttactcctgtgtcttctagtgttttgtattaaggaaaacaaatgcatggccaggctgattattaatcttttgtgaagagtctaatatttttcatgttgatttttattcctttgtgaagaataaatatttttaagagtatttgtgggattctttcatctctgaaatttgatatttctatctgattaagctgtgtaagtctagttgtctagtttcttttcatgaggtttttcctaagcatcaaaaaatacgttcaaaattttatgctagtataaatttcagattgggaataatttttttgttatttctctgattattgattattttgttttctgatgcatactcttataggagataacatcttctagaattattcttcatgtatcttatcttctacctccttttgttcatgtctttatcttcttctgctaattctgggataatttgttgagtttatcttctccagcactcattcatttcctgcatatctttcttactgccatcatccagttagtttggcattatgttttttgacctcactsggacctttctaatttaagtcttcctttgtgaatatttcccagctacagagatgccatggcttcttgaacccttctggaagagaatctaatattttctaaaaatttcttctgaattttggagtaaccctattttaaaaggagatattccatcattttttaaaacaatgactcacttattttggacaccactattttctcatatactttggatttgctatttttaagagaaggaggctcaatgctgatattaatcaagtaggaattgaggtaggctaatgtttgtgtgtgtacttttcactcatttttagaaggacccttagcttcagagtccccagagtcttgaatgaggtgagaagtggaaattcagaaggttggaatgccctatatagtcatcacataaagttttaacaataccgcacatttatagatgaattactcaggaaattcattctcctctctatactgcctcatatatttctactccatgtcctcttctgcttatcttgactcccattccagagggaaatctcaggcagagtttctaatttttaaatttctgcctgctttggggctgccaatttcaggaaggtatcgctgagtctttcagtattgccagtggaatcgaactccagaaaaactcaaaggacaccacatggctatctccccagtgtccaatagcctgttcccaatgccattcccaactcttctaaattcatctggggcttaatagactctccccatcccaactcttctaaattcatctggggcttaatagactttccccctcatagacttccatgataagctgctctgtttcacaatagggaagcttacacaggcctttccttcaatctcatcctgccctccctagctaacagaaattyctagaaatatctagccagtgagagcatccatttctagtttcatcctataatgttggttttcataatgttggttttaaatgtaattattcattacaaagtatttgtgagggagtagagaagaatgggtacttataataaaagcatgactttttaatgtatcaaaactatacagaaacaaagacaacatagagataactcttgaagaagacagaacatcaacatcataagccccatttccttattttgaagtgtgggtcttctattcaatttctacaatagatttcaaatgtaatatttgataatgaaggtgatgataacaatgatattgatgataagagatgatactgatgagcacacttaagtgcttaatttatgataataatcattgttaacattcattagccttattgtatatcaggcactgtgctggcttctttacacacatgatcccagtgaatctctgtaacaggcctataagagagacacataaatttatcctcaccttatatatgaggaaaccaaggaacagactagttaagtaaggtaccagaggtcacacagatagtaactgacagaactgagacttgaatccagatcagtctggctacagagcccatgttcttatctactgtctgattaaaaataatatgacacatgacaggtacaagttacatgagaattcctttgacatgtgaatgaatggttctttgaagacagagtgcagtaaattccagtctataaaagagttttttgaataatatgatgaccaaacttgtgtgtccagggcaaaaggagggtacaaatagacagaatatgcaagatagagwaatgctggagttaagtctcagatatctttgaagcaagagtttcatccttaatttgcttggtgggcatgtgtttcttacatataagatttttatgtttctgaagcccagaggataagatggagaattcagctcagggttggcctaagggagggaggtgaactagcgagaaagaaaaaggtcccataagacaccccaggaagaaccagactactgaggaagattcagactgttgaatattatgttaatgaagacaactgagtcactctatgcctagtgtttatttcttttgtacttaaagattccagtgttttctagtaaaaataacatgtctgtactaaagggacaggttggcaggagaaatcattaatgggagatggaggatggccctggactatgtgtgtgtgtctctgtcaagtcgtggtgggaacccaggggaaaggctttatgtttgtgcagattttttattttgactcattctatgtattaagaaatatggagaagactacaggcatattttatcttataggttaaaaacaatgtaaatgaccttagaatgacttttgtgtgaggagcactttaaaaaaaaatagaaatctttagtatccttgaacccctaatgtgattaggtctaattgtgctatcagtataaatatgaacaatcatggcattagaagctgtaattgcctaattatgacttgcactaatgtgatgatttttgttagatctgaatcctaactaataggactagtctgccaaatctgaagtcagaaataaaagtcaaatcaagtattattttgtgtccctgggtaaattcaccagtacaatttctccatgagctagagaccctggacttctggcttttctctgctatatatcttataccatcccactcaggatgtgggcacctgatcattcaatttaagtcattcgtggatgactactaaaggaaaatggcagtaaaggtattgaattagtgtggatttttattagcacaatattttattattctttaaaattttcctaagagctgattaacataaactctttgcagattgaaatcaatcctctcatcaggtaaccaacataaaaataatcagggcattcctgagggatcacatataaaactgacagaggcaatgaagtgtcctgcccactttccagcatgttccttatgatcacactgccttcctccgtacctgttttatctcacctgccaatgtttatttgtttcctggaggaaagtcttacaaagcacactccctaaatattatttgaaagtccagatgtacaggaacatttatttctcagcgagtgagttgtccactagtgcaagaagcagaggcaatagttcatctctctctgtctttggaaaatttggtgactagcagttaacactcatagagagaaaacaatgatgtatagaaagtccagcgtggaagactatattttctccactttcctggtctatttgtgatattttagttgcttcaacaatgactgaaataagactggttatacacaaggctgactgcttggaagcattctttgttcctgggttttaggtgtgtgagtgtgatagaagactcctcagagatcctccataataaaaccatctagatgacaaacagaatgatctgtacaacaaattctgaattataatgggtaaaatgaaagcaaactccagagtatttctttttgtgtcctacagcattagatattttgtctggtagccacatacgcaagacccaatctcgtttcagtctaataaattacataaagctatttttgcagtcaattagcatgctgaatgtttcaacttccacatgcgcattctctttcttttctacagtttgtaaactgctggagaggtgtgttaacattctatttcaatgtcacagtgagaggaagtggtgataatagaaggcaggggcaggacatgttgctttctcgatacttttttttctgtttttcttttttcttttttttaaagaggtgggacctctaaacagatgagtgttagctctaagtaaaatatagttctaagcatcacaattctgtgcttatattttaataggtagttggtgtttcctagggcggctataaaggtatcacaagctgagtggcttaaaacaacataaatttattttcttccagttctagaggttagaaatctgaaatcaaggtgttggtagggccatactctatctgaaggctctagggaaattcctccattgcctctttctagtttctggtggttgcaggctgtagctgatgttctttggcttatagatgcctcgctccaatttctgcctccatcttcatgtggtcatcttcctagtgtctctgtgtccaaattttcctcttcttagaagcacacccaatattggaattgagttcaccctaattcattatgacctcatcttaactttgttacattttcaatgactatttctaaataaggtcacattctgagatactgggggttagaactttcatgtcttttgggggaacaaaattaaatctgtaacaaatgacaaaatggaaagtttcattcttgcatttgctcagagaagggtccctaagggaatagttacccatcagatttagcaactttttcctagaagcctcatgagaggggtcaggatgaatgcacctgttctgcatataaggtaggcagccaccctccaatatcatcaaattcaacactttatagttaaaaaaaattagcccagaatcttaaataagctacaaagtttacaaacaactaatgatgaagaggctgagagtggattccactgttgcttgatttctggcctggagttcttccttcctgctcacactgtgggggcatgttgaggtgcacaatgcttctgtggttacccagtaggacagtgacagcttgggatgcctcctgtcacactgtgaatcttgtgaagttacttttaggccaccttgtgactagccacttcaaagtctttaaaagacaggaggtataaatgaaatgaataaaacaagagcttaagctattatctctcctctggggcatttgcattttaatggagcagcctgggctctgtcccagacctattgattcataatctccaagggagagtcctgggagaatctgtattttagagagcataccaggtgactcagatagttgggcatgtttaggaaacactggcacagagaaattctgacttctgaaatagtaagaaagaaatatttactggaaggattttaggtaagagccaggtggggatggtgggggaggaagggaagctactacttgatggcctccaaaaaacacgagtcagatgcataattctgtattctttgcccaaagtctgaggcctggtttctgccccaggaggaattcagaggaagcaggttttctgggcttggagtgtagtatccctcttaggagaagcaagagagatttaggattgcttatttattgcagaacccacgtcttcttgcagattgcaaagccaattctgaaactgcctttgcaaaaattaaaacagtgaggaaactatgacagtgaggagatctgtctaactaactcccatcttgccttttaaccttccaactgcccttcatcactcctgggctcaggccacgctaacttcgaaagacatttattttgtagtttaaatgataatagcccttctcccaaactaaaccaccttggtacagctgataaaagacaaccaggttaggaggatgagcaatctgaattctgctcaggtgttgacctaaaggattacccaccatgattccagaagtcacaagatttgcaaatcccccaattattgctgcagataacatctctggaactaagattggccttttgagatgttttttcaggtgtttgcatttctgatgaccaatagcttcacctggacctccccacgccctctgaccagtcctgtggccccacccagaagcggactccctggcccaccaaactattattgaaaaaccatagcctccgaattttctgggagatcggtttgagttattactctgtctcccacatggtgtggctggccttgtgtcaattaaactccttcttcattgcaatgctgtggtctcctgagttggttttgtctatgcagtgcaggaagaatctgttggctggttacaattttatattaagggagggtacccaagagaaaattctagcccatttctattgcttcatttttcacattgcatgcagtcagtggtgatgtactttctctctctctttttttagagagagagttcctttttttttttttttagagagttcctcattacttgttttgaacctaaasttataatttagtgtctgtgacagcacatttgattgtttttaaatgaaggtgataggaaaggcagaagaatgactagggaagaaaatctggagaacagatgacaagataacattgcttttgattctctgcaaacaagcatggtattgaaaaatgatccaaaatcgtttgcttgagcaccacagttacttttgagtaatatttttgtgagatacttttaaatttatttttttgaagtctggtgctctgaaattgaatttgaagtcagcttaataccaaagtgtgacacattctctttcagcaggctttactgtatctcacgtctatttagtttttacaaatttagttttcatgatttctgcatctttggaatacaaatcctgggatggtttctatctgaatggagtcttcagtgaatggtgacatggtttcctttattttttcctatttcttttttttttgagacagagtctcgctctgtcgcccaggctggagtgcagtggtgcgatcccggctcactacaagctccacctcccgggttcatgccattctcctgcctcagcctcccgagtagctgggactacaggcgcccgccaccacgcctggctaattttttttttttttttgtatttttagtagagatggggtttcaccgtgttagccaggatggtctcgatctcctgacctcgtgatctgccctccttggcctcccaaagtgctttatatcttctgtcttgattaattttcttcctctttggtaacacctgttgtctcttacggaccaaccctgtgctagggctgaggcacaaggagctctaagaaccaagctgtggccgggcacggtggctcaagcctgtaatcccagcactttgggaggccaaggctgtcggatcatgaggtcaggagattgagaccatcctggctaacacggtgaaaccccgtctctactaaaaatacaaaaattagccgggcatggtggtgggcgcctgtagtcccagctactctggaggctgagacaggagaatggtgcgaacccgggaggtggagcttgcagtgagccgagatcgcgccactgcactccagcctgggcgacagagcgagactcactctcmaaaaaaaaaaaaaaaaaaaaaaaaaaaggaaccaagttgtgagtgagaaggacctggaaaggcactgttagtggcagtggatccgtaggggtctgcaggaacctcaactcttgcgtcctcagaagaattcgacggaggaggcatgaggcagaaggagagacagaggcaagttttatagcagaagtgaaagtttatttaaaagctttagagagcaggaatgaaagaaaggaaagtacacttggaagagggccaagcaggtgacttgagagaccaagtgcgctgtttgaccttgacttacggtttagtatattggcatacttctggggtcttgtgtccctgatttcctgatttttccctggagggtgcgccgtctgtatgcgcagtggcctactagcgtttgggagaggccgtaggcgcagtgtgtttactggagttgtacgcrtgctccctagagtggttcttcccttcccggtctagcattcctaggggaaagtgatgtaccagttaagctctgctgttttgcctcttagtgctcatgcttgagcccactcgcccaattcctgaaatcttagggggaagcggctgatcaccagtttcagatttttcctatgtattgtgagactgcctttccctggcacaggctgcaactaattattattttagagacacagtaaacaaccacttgatcatcacctgatggtcagctggtgtgtgtatgggggggttgggagggccctctcctgccctgctcatgtgtgattagctacccagtttaacaggaccatgttattgcatcattaaaagtgaagtattatgccctatgtcaggagggtagaggtgcacagataaggtcagtggaccccagttaagggggcagggaatacttcctggaataaattacatttgagctgaaacttgaaggatgtatttaggtgatgtagacaagtggttggagcagagatctcatctgtacccacatactccaccttccctcttgctgcaattgattatctactcccatgtaagacaagcccttgacttatacactacctctcatcctctgatattttcaagtagctcattctgcagttggctcttcatcctgcagtggcaatttttactatttacatggtcttttgcataaacatgcaatattttctttctttgaaagcaaaacaaaactcccttaatccacattcacctccagtatatgtctcatttttctgttactctacagccaaattccttgaaattgttacttatattcacatctccatttctttgcattgcgtacttcctgaagctcattgcaattatagtttcatccttgccatttcactgaaatcactcttgtcaaggtcacccactgcctcccataatgccagagtggtcaatttttagtatccttactgtgcaaccagctctcatgattgtacccagtcaaatctctataataaattatacatctctctacagacctggactgaaacattgctatttggtgttttaccctatttagagccaaaatatattttcataagaagaaactcacagctgtcacatgtawgtaagttataaactgatttcagaatctccaatacagaaaatagtaactttagtgttcctattgtttggtactctaataataattagagaaaactgagagtttgggattatgtgactacaggaaatacctgtaattgccaattggcttcataataagaaaattggcagggctaagaaggcccagggaattaagaatataaatgtagaggttaacatggagaactacttagcatgaaagaatatggatgtttcatttaatttttttcatatcaaaaatctctcttcttgtaccaatttctgctcattggcttatagcaggtacagttcagggactctagcattgattagtataagttcctaattttcaggtgaaggcactgaggcccaggagagtgaagggcttgaggtcaaacacccatgaatggagaaggcttctggccccctccaatcccctctgcatctcactaacaggactggaagctgctgaaacagaggtattggaagcccacagatcatcaatatacagtttgaacttgtagtgaggtagacaagaataattcatagggatgtattatagagtaggtagagaaggctgactcctgacagtggcatatttgataaaaatccycccaaaggcatttagtacctggtaggctaatggctcatgagagaaaacacaagaaaggagatgatatgggagggtgggaaagccaatctttaggtaaaaaattacaagtcgtctttaaactatttactttaaaaattactagtttttctgctctgcatgctaatatgctactctttttttctcaactttattatttctctttgaatgtatattagtccattcttacattgctataaagaaatatcggagactaggtaatttataaagaaaagaggtttaattgcctcatggtttcatagrctgtttgggtagcatggctggggaggcctcaggaaacttttaatcatggtggaaagtgaaggggaagtagggacgtcttacatgaccagagcaggaggaagagagagaagggggagatggtgcacacttttttttttttaagctttgtatctaatttggcaatcttattccagtatttttctttttctttttttttttattatactttaagttctagggtacatatgcacaatgtgcaggtttgttacatatgtatacatgtgccatgttggtgtgctgcacctattacctcgtcatttacattaggtatatctcctaatgctttccctcccccctcccccaccccatgacaggccctggtgtgtgatgttccccttcctgtgtccaagtgttctcattgttcaattcccacctatgagtgagaacatgcggtgtttgtttttttttgtccttgtgatagttttctgagaatgatggtttccagcttcatccatgtccttacaaaggacatgaactcatccatttttatggctgcatagtattccatggtgtatatgtgccacattttcttaatccagtctatcattgatggacatttgggttggttccaagtcttcgctattgtgaatagtgccgcaataaacatacgtgtgcatgtgtctttatagcagcatgacttctaatcctttgggtatatacccagtaatgggatggctgggtcaaatgatatttctagttctagatccctgaggaatcgccacactgtcttctacaatggttgaactagtttacygtctcaccaacagtgtaaaagtgttcctatttctctacatcatctccagcacctgttgtttcctgactttttaatgatygccattctaactggtgtgagatggtatctsattgtggttttgatttgcatttctcggatggccagtgatgatgagcattttttcatgtgtctgttggctgcataaatgtcttcttttgagaagtgtctgttcatatccttcgyccactttttgatggggttgtttgtttttttcttgtaaatttgtttgagttctttgtagattttggatattagccctttgtcagataagtagattgcaaaaattttctcccattctgtaggttgtctgttcactctgatggtagtttcttttgccgtgcagaagccctttagtttaattagatctcatttgtcaattttggcttttgttgccattgcttttggtgttttagacatgaagtccttgaccatgcctrtgtcctgaatggtattgcctaggttttctcctagggtttttatggttttaggtctaacatgtaagtctttaatccatcttgaattaatttttgtgtaaggtataaggaagggatccagtttcagctttctacatatggctagccagttttcccagcaccatttgttaaatagggaattgtttccccatttcttgtttttgtcaggattgtcaaagatcagatggttgtagatgtgtggtattatttctgagggctctgttctgttccattggtgtatatctctgttttgktaccastacyatgctgttttggttactgtagccttgtagtatagtttgaagtcaggtagtgtgatgcctccagctttgttcttttggcttaggattgtcttggcaatgtgagctcttttcagattccatatgaactttaaagtagttttttccaattctgtgaagcaagtcattggtagyttgatggggatgtcattgaatctataaattaccttgggcagtaaggccattttcatgatattgattcttcctacccatgagcatggaattttcttccattcgtttgtatcctcttttatttcattgagcagtggtttgtagttcttgaagaggtccttcacatcccttgtaaattggattcctaggtattttattctctttgaagcaattgtgaatgggagttcactcatgatttggctctctgtttgtctgttattggtgtgtaagaatgcttgtgatttttgcacattgattttgtatcctgagactttgctgaagttgcttatcaactgaaggagattttgggctgagacaatggggttttctaaatatacaatcatgtcatctgcaaacagggacaatttgacttcctcttttcctaactgaataacctttatttctttctcctgcctgttattatgttgaataggagtggtgagggagggcatccctgtgttgtgccagttttcaaagggaatgctttgagtttttgtccattcagtatgatattggctgtgggtttgtcataratagctcttgtttttttgagatacaccccatcaatacctaatttattgaragtttttagcatgaagggctgttgaattttgtcaaagggcttttcttcatctattgagataatcatgtggtttttgtctttggttctgtttgtatgctggattacatttattgatttgcatatgttgaaccatcctcgcatcccaaggatgaagcccaggtgatcatggtggataagctttttgatgtgctgctggattaggtttgccagtattttattgaggatttttgcacaaatgttcatctgggatgttggtctaaaattctctttttttgttgtgtctctgccaggctttggtatcaggataatgctggcctcatgaaatgagttagggaggattctctctttttctattgattggaatagtttcagaaggaagggtaccagctcctccttgtacctctggtagaattcggctgtgaatccatctggtcctggacttcttttggttggtaggctattaattattgccttaatttcagagcctgttattgatctattcagggattcaacttcttcctggtttagttttgggagggtgtatgtgtccaggaatttttccatttcttctagattttctagtttatttacatagaagtgtttatagtattctctgatggtagtttgtatttctgygggattggtggtgatatcccctttatcattttttattgagtccatttgattcttctctcttttcttctttattattcttgctagctgtctatcaattttgttgatcttttcaaaaaaccagctgctggattcattgattttttgaagggttttttttgtatctgtatttccttcagttcttctctgatcttagttatttcttgccgtctgctagcttttgaatgtgtgttctcttgcttctctagttcttttaattgtgatgttasggtgtcaattttagatctttcctgctttctcttgtgggcatttagtgttataaatttccctctacactgctttaaatgtgtcccatttaaaggtgatttggggtggagagttctttagatgtctattaggtccacttggtgcagagctgagttcaactcctggatatccttgttaactttctgtctcgttgatctgtctaatgttgacagtggggtgttaaattctctcattattattgtgtgggagtctaagtctctttgtaggtctctaaggacttgctttatrtatctgggtgctcctgtattgggtgcatatatatttaagatagttagctcttcttgttgaattgatccctttaccattatgtaatgaccttctttgtctcttttgatctttattggtttaaagtctgttttatcagagactaggattgcaacccctgcctttttttgttttccatttgcttggttgatcttcctccatccctttattttgagtctatgtgtgtctctgcatgtgagctgggtctcctgaatacagcacactgatgggtcttgactctttatccaatttgccagtctgtgtcttataattggtacatttatcccatttacatttaaggttaatattgttatgtgtgaatttgattctgtcattatgatgttagctggctattttgcttgttagttaatgcagtttcttcctagcatcagtggtctttacaatttgtcatgtttttgcagtcgctggtaccagttgttcctttccatgtttagtgcttccttcaggagctcttttagggcaggcctggtggtgacaaaatctctcagcatttgcttctctgtaaagaattctgtttctccttcacttatgaagcttagtttggctggatatgaaattctggkttgaaaattcttttctttaagaatgttgaatattggccccactctcttctggcttctagagtttctgccaagagatctactgttagtctgaagggtttccctttgtgggcaacccgacctttctctctggctgcccttaacattttttccttcatttcaactttggtgaatctgacaattacgtttcttggagttgctcttctcaaggagtatctttgtggcgttctctgtatttcctgaatttgaatgttggcctgccttgctagkttggggaagttctcctggataataccctgcagagtgttttccaacttggttccattctccccatcactttcaggtacaccaatcagatgtagatttggtcttttcacatagtcccatatttcttgaaggctttgtttgtttctttttactcttttttctctagacttctcttctcacttcatttcattcatttgatcctcagtcactgatatcctttgttccagttgatcgaatcagctactgaagcttgtgcattcattacatagttctcatgccatgtttttcagctccatcacgtcatttaaggactcctctacattggttattctagttagccattcgtctaatcttttttcaaggtttttagctttttttgcaatgcgttctaacttcctcctttagcttggagaagtttgatcttytgaagccttcttctttcaactcgtcaaagtcattctccatccagctttgttccattgctggtgaggaactgtgttcctttggagagggagaggcgctctgatttttagaattttcagcgtttctgctctgttttttccccatctttgtggttttatctacctttggtctttgatgatggtgacgtacagatggggttttggtgtggatgtcctttctgtttcttagttttccttctaacagttagggtcctcagctgcaggtctgttggagtttactggaggtccactccagaccctgtttgcctggatatcagcagtggaggctgcagaacagtgaatattgctgaacagcaaatgttgctgcttgattgttcctytggaagcttcatctcagaggggtacctggctgtgtgaggtgtcagtctgcccctactggggagtgtctcccagttaggctactcagggttcagggacccacttgaggaggcagtctgtctgttctcagatctcaaactccattctgggagaaccactactctcttcaaagctgtcagacagggacatttaagtctgcagaggtttctgctgccttttgtttggctgtgccctgcccccagaggtggcatctacagaggcaggcaggcctccttgagctgcrgtgagctccacccagttcgagcttcctggctgctttgtttacctgctcaagcctcagcaatggtgggcgccccacccccagcctcactgyagccttgcagtttgatctcagactgctgtgctagcaatgaagggggctccgtgggcatgggaccctctgagccatgtgtgggatataatctcctggtgtgccgtttgctaagaccgttggaaaagggcaatattagtgagaggtgacagcatgctggcagccctcacagccctcgctygctctcagcacctcctctgcckgggctcccactttggcagcacttgaggagcccttcagcccaccgctgcactgtgggagcccctttctgggctggccaaggctggagccggctccctcagcttgcagggaggtgtggaaggagaggtgcgagcggcaaccagggctgcacagggtgcttacgggccagctggagttctgggtgggcatgggcttggtgggccctgccagagggccctctcagagtggccacctggccctgccagccctggggaatgaggagcttagcacccggaccagcggctgcgcagggtgtgctgggtcccccagcagtgccagcccaccagtgctgtgctcgatttctctccaggccttagctgccttcctgtggggcagggctcgggacctgcagcccgccatgcytgagtcccgcccccacccccacgggstcctgtgcagcctgagcctccccgacgagcgctgcccactgctccatggtgcccagtcccatcgaccacccaagggctgaggagtgtgggcgcacagcacaggactggcaggcagctccaccagcagccccagtgcgagatccactgggtgaggccagctgggctcctgtgtctagtgggaacttggaraacctttatgtctagctaagggattgtaaatacaccaatcagcactctgtctctagctcaaggtttgtaaacacaccaatcagcaccctgtgtctagctcaggttttgtgaatacaccaatcgacactctgtgtctagctactctggtggggacttggaaaacttttatgtctagctaagagattgtaaataacaccaatcgacactctgtatctagctactctggtggggacttggagaacctttgtgtccagctcagggattttaaacacaccaatcagcaccctgtcaaaacagaccactcggctctctgtaaaatggaccaatcagcaggatgtgggtggggccagataagagaataaaagcaggctgcccgagccagcagtggcaaccrgctggggtccccttccacactgtggaarctttgttctttcgctctttgaaataaatcttgctgctgctcaatctttgggtacacactgcctttatgagctgtaacactcactgtgaaggtctgcagcttcactcctgaagccagcaagaccatgaacccaccgggaggaatgaacaactccagacgcgccaccttaagacccgtaacactcaccgcaaaggtctgcagcttcactcctgagccaaagagaccacgaacccaccagaaggaagaaactctgaacacatccgaacatcagaaggaacagactccagacgatccaccttaagagctgtaacactcaccgtgaaggtccgcggcttcattcttgaagtcagtgagactaagaacccaccaattccggacacattagggtgtgagtgacccgattttccaggtgctgtctgtcacccttttccttggctaggaaagggaattccctgaccccttgtgcttcccgggtgaggcaatgcctcgccctgctttggctcacacttggtgtgctgcacccactgttctgcccccactgactgacgagccccagtgagatgaacccagcaccttagttggaaatgcagaaatcaycygtcttctgcgttgctcacactgggagctgtagactggagctgtttytatttggccatcttggaaccaccttcccaatagtacacatttttaaacaaccagatctcatgagaactcactcactatcatgagaacagcaagggggaaatcagcccccatgatctagtcacctcccaacaggtccctcctccaacattggggattataatttgacatgaaatattggtggggacacaaatccaaaccatattagaatatatgcacaggaaatggcctaaagatgtcatatgcccttggttttacttagagtttgaaaatcaggttatgaggtcacttatttcagacagtagttcacattatttaactatcctctgtcacttttagagtttttattttattaaaggctttaattggtaatactcatttctttttcttttattagcattgattttactttctgtagaaatacagaaagcattttcaaatgctaattttattatgtctgtatctggtagaagattcaaaacattgctccaaaaacacttggcagcaaattccccattcactggcaacctgaaatrtaagtttattgagcatgaatgataattcgttatcagatgtaagtcttggctctaattacaagatgcttgtagtccaacatgtagtctaacaccttatactctgatcaagtataagaaagaggccaatttactagtagaaattgcaacaatgaataggaaaaaaaatgtacgctgcaaagcagagcactgtgagagaagaatgtatggtatattcatagtggttgagggggagaggattaatagcttttggacatattacagaatgttaattacatgcaaaacaaaatagttctgtatagggaagtgtgaatgctgtacatagcatgtgactagcttgcatttaatggggaaaagaatttaactagataattagtatatatcaaatgcaatttatgtgtcagacatcatgctatttatgtattttacacaattattatcaaaatgtaatacattaccaatgactagaaataatagttgaagaataakaatagtttcataaaaagtgtaggataattgaatcagagagagacattcagagaagaaaaacgttatgaaaaattttaagtagtagtttgaaggaagaaaaaagagttttccaaaaagaaaatgtctggaaatataaagyaattcaaaatttgagaagcagaggttttgctttagtaaggagagggtaaatagatatggctggtagagtgtaractgtgaccagagcagcgattctcttggcttataagaggaaactgctgggtaatcccaaagggccttgaattgttgatgaaatgtaagttctttgtggagttaattttggtcaaacattgaccaaaatgtttataaatttccttttttcgtggtaaaataaaattgtcttatgattgcttcttgagtgaatttttaaggatattaaaagttggtattccttaaaagttaaccttttacggttaataaactattgctatagtttattatggtctttgattcatttttctactaggttacttgagactgctacacaacatcaaaaaaattctaatgcacatgggcacaggtttattgtttgaattcccataaaaatttaaaacatsactgaaatggcaaagttgatttaacattaaatgtaacatatcacattaaaaatagaagatactaaagaaaaaatatacaaatattgtagtagatggaggaaaacttctctatgcattratgataaaaattatcaggaagttcagagtagaaggaaaagttttcaacctgaaaaaccatttttactaaaagcctacagcaaacatcatgcttgaagattaaatagtagaaacactccttttaaaatgaaacatgacagacatgcatatgtttttattttttgcttttttctctctttttcttgctctcccagtcttcctcttttttcttttttagtattatattggaggtctcagaatgctcaggaagacaagaaaacaaaaatatattggaatatgagcggaagactttttttgtcattacttataattgataaaattaacttcacagaaagtcctctacaacatacaggaaaactatttgaattagtatgaaagcttagtgacagtattggatatacaaaatataaatctcaattgcaaatctatacacaaggatgaaagattaggaaatatattttaaaatatattatttacaagagcagtaaaatatattaaggtcctagtaataaatcaaataaagatgtgcaagacctcaaagaagaaaatccagaaaactttattcaacaatgttaaagaagagagacagatcatagggagacacaatagcataaaggtccaaattctttccaaattgatatatagtctaatgcaatttaataaaaatcccaaacactaatttttatgagattagacaagctgattctaatatatacatggaagaacaaacggccaagaatagccaacatatgcttaaagaaacaaaatcaaggggcttataataatgctgctataattaagartggatgattatgtagatcaatggaatagaacagaaagttcagaaattgacatgttaatttagggaaattaaatattttgaaaaggtagcattgaatattagtgagcaaataattcttttattaagtcacctggtacaatgattatttatatagaaaatttataattggatctctacttcacatcatatatgaaattcaattccaggcagatttaggatttagatgtgaaaaacaaaactttaaaatatttagagaataaatgtttaagaatattttacagggtaggggaaaatttcttaagcaatcacatgtagcataatgtcaaaatggaaaggctgataaattagatttaaacaatctaattttaaattagatttaaacagtctaattttaaattagatttaaacagtctaattttaaattagatttaaacagtctaattttaaattagatttaaacagactaattttaaattagatttaaacagtctaattttaaattagatttaaacagtctaattttaaattagatttaaacagtctaattttaaattagatttaaacagtctaattttaaattagatttaaaaaattaaggccttttcttcgttcaaagatactttaaattttgtaaaaaataagcatcaaattgaaagaaatttgcaatacttttaaccaacaaaggattaatgttcagaatgtatgcataactcctatgtttcatataggagttagaaaaaaacgaagagcatacggaggatatggcagaaattttaggttttttaaaaattagatgttgtttggactgtatatacatttttttgttcctttataaaaaagtaacagctttgagatataattcatataccatcatacatttcctttaaaatgtataatttaatggtttttagtatatttacaattatgtaactgatagactctttgtgttccttagctcagctaggtctgagttcttgtcaaatgaccaggaagaattaggcacgtggacaccagagagtgagtggagtarrattaattaagcgaaatgaaaactctcagtggagagtgtatgtggggaagggggtggttcccctacctgaaggtgggaaggccccccaacctgccgccccatgtggctgggtctggggtcttttatggactcagaatggagagtgcatgctgattggtttgtgagtatgcaaaaaaggttaaaacaaagacaccactcagacgtgggcatgagagtgtagaagaccaattaggaaagggtaggtatatgtaaaatagatgaagggtgaggatcaatcacagaaagcatgacaaacaggaaaacaagttctcaagtcagtctgaggatttaacttgcagcttggttttcaggctttaagctctttggctcggaggtggggtttcaccatggagccacccctatctgcctaggtatttggctgcctcctgctactctgatagccaccaccacaatacattttagaacatttttaacaccctaataaagaaacttgggactcattagcagtcaatcccaatctcctcctccctaacatctccagccctaggcaaccactattctacttttctctatagattttcctgtgctgaatatttcatataaatagcaccaaataatatgtggtttttgtgtctggttcctctcacttagcataatattttcaaggttcatccatgttacagtacatatcagtacttcatttctttttattgctgaataatattccattgtatggatataacacgtttcttttccattcatcacttgatatttaatggtttccactttttgtctgttaggaacagtgctgtaatatacattcatgtaccaagtttttatgtggacatatattaataatttcatttctgctgggtatgtaactaggagtagaattgctgcatcataaagtwattctatatttaatctgagggactgttagacctgttttccagagtgatgatacyattttatattcccacaagtgtccycatggatacttgttattatctgtttcttaaattatggccatcctagtagatgtgaagtggtatctcattgtgattttctttggcatttctctagtgtctaaggatgatgagaaagttttcatgagtttaatggccatttgaatattgtctttggtgaaatatacattggttttaaataaacattgcttcataataacacaactttaaagataaacagaatgaggagaaaatagaaaaaaagttaatgtagataaytctttagataagctttgctgtgaatagaagcagtgaaaggagataattcaaaggacatgtgagttgaagaaaggcttgcaaatgttccggttcagcaatttcttttatgccacagtgataatagtagcccacagtcacagtctcagtgggcacagagtgagggaggcaaagtgagggacagaaatggggaaggaagaggaacacaggagggaactgagtttattgcaaaatgcagaagaatggttgaataatagaagagtcaccttgtctggcagaagtgttgaaaatgggctcttgtaggggcagaagaaaagcactcaggccattggataggcagactttttcccttgagaatccatgactcttgtcaccctttgcttccctctctacccagggactttactgctttacaacctaaggaaccagctaaaacaacagcaacaacgataacaacaaacccaattctcacccgccgcacctgcccccaccacccgcaaaaarcaaatccaaacaaaaaactatttaaaaatcacacaattcacaaaaagcgtctcaagagtatgttaatgtaaataccatttgtattaaacccttaccttatttaaacgtacacatagrgcttgactttaagaaacccatgcatgaattatttgaataactgaactaatgaagggtgaaattaaaataaatatattcaaataatgagaggyggtataagtgaagggaaatatggtttaaattctgagtcttataaaaataatatgtatgtacatgtagtacaactattaaaatttgggctattcttgtttcttaatatttttgtgtataatgataaaaaacaataaaagaaataaagctatttgatttggatgtacagagaaaaatccaagctatgggaagtacattgtgacccccaggtgtatacatatgtacataagctggggttaagctattgccttaattttagccccacccatgtacactctgtgacgctgcctgggattctacaaatcacatttatcttttgccactaagctccctgttaggatctgccaatcagaggacgctaggggcggactggaaggctgagtggggaagaaggaagacacttcctgtttgcttcctgttctgtttaacgacaccctaasgattacttttcatttcagcagttatagtttgtttcagtagcaacagttatttccagttttagttttgacagcattcctagaactagctccttagggttttttaaagacaccaacgccaaccagcaagcgccccctactgagcggtctaggtcccagctctgagaagccactcaagtttctaagtttagtatttatattataattctaacctcttccctttgttgtctcagcactaggtagctgcttcctatgttgcttataccatgatattttagtattccctcttgccttctccatttttcaatatctggtcggatagcaattctttatattgaattatttctgtaaaaataactgttggggtttctattctatatcttagatggactctaactgaattaatacatatgtaaatatatggtgaatatatataaattataaacatatgtctctatatgtatatatagatatgtgtctctatatcaatgtatgtattatagatatatacatatatgtatatatagaaccatagataattctccttaatatgcatgtacatagatatgtacatccatattatatgatatagaatatataaatataatatctaatatatgcatattaaggagaattatctatggttctaaatatgcrttatacatatctatatgcatactgtatatcatataatacatatccatgtacatgcatattaaggagaactatttacggtttttggtctcatttgtaatgctcataaaaattttctcttttaattttaatttcattgaaaccatccttggactcatacttggagacaaacttacttggtcactatatattattattttgacacactttggtgttcagttagctaagttagaaatttagtttatgtgtttattagttaaaataaataattgactttccttgtactgtctttttctggttttgatgtcagtgttgtttagctttgaggaatgggctaggaaatgtttcatatattttgaaataatttgtataaattggaattatttgtttcttaaaggtttatggaacatctaaagaacaaattcatctggctctcatacagtttttaggatactactttgattgacatttcagtttcttttagatctatatcttctatttttcttgaggctattttgataattatttcttaagatattatcaattttcatctagataawaaaatatatcattttatgtatttttaaattcatcgatatttccacttttcattgacaacattattaagttttattgtgtctcttttttcaaattatacttgatgaaattttgaaaatgattggtctttccaaaaatcacctttaggttttattgataaactttttcttattttctaagtcaggatacaaaatcagtgtacaaaaatcacaagcattcttatacaccaataacagacaaacagagagccaaatcatgagtgaactcccattcacaattgcttcaaagagaataaaatacctaggaatccaacttacaagggaggtgaaggacctcttcaaggagaactacaaaccactgctcaaggaaataaaagaggatacaaacaaatggaagaacattccatgctcatgggtaggaagaatcaatatcgtgaaaatggccatactgcctaaggtaatttacagattcaatgccatccccatcaagctaccaatgactttcttcacagaattggaaaaaactactttaaagttcatatggaaccaaaaaagagcccgcatcaccaaggcaatcctaagccaaaagaacaaagctggaggcatcacactacctgacttcaaactatactacaaggctgtagtaaccaaaacagcatggtactggtaccaaaacagagatatagaccaatggaacagaacagagccctcagaaataaygccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcatcaccattcaggacataggcatgggcaaggacttcatgtccaaaacaccaaaaggaatggcaacaaaagccaaaattgaccactgggatctaattaaaytaaagagctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaamaaacaaccccatcaaaaagtgggcgaaggacatgaacagacacctatcaaaagaagacatttatgcagccaaaaaacacatgaaaaaatgctcatcatcactggccatccgagaaatgcaaatcaaaaccacaatcagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagtttattaatttcttttaaaaaatcttcaataattctaccctaattttctgagcattttcttagccatctgaaagcttagttcaacaattttcaatgttttgttttttaatactaccttggcataacactgagggtatatccttattttctcattctcacactctcaatagttctatgtagtttgtaattttcattttgctgttcccttgwcctaaaagtaattttgaatgcgaagagcacttttcagtcacttaatttttaaaataaattttattgtgtacatttaaagtatacagcattatgttatggaatacacataggtagtaaaaatttattatggtgaagaaaattaacatatacataatctcatataggaagaaaaaactttgtgtgtggaaagagcagctaaaatctactgatttagcatgaattctatgtacagtacaattttattacctatagtcttcatcttgtgcattagatctctacatttgtttagcctatatatctgctactttggttttttttatttacttttaatttttgtgggtatacagtaagtgtatatatttatggggtacatgaggtgttttcatacaggcatgtaatatcaaataagcacatcgtggagaatgggatatccaccccctcaagcatttattcttggagttacaaacaatccatttctattctttcagttattttaaaatgtacaaataarttgttattgattatagtctccctgttrtgctatctactaattaatagtagttcttattcataccttctattwttttttgtgcccattaaacatccctacctcccccaccaccaacatcccactatccttcctggcttctggtaaccatccttctactctctctgtccatgagtttaatagttttaatttttagatcccacaataagtgagaacatgtgatgtttgtctttctgtgcctagttcatttcactccacatgatctccagttccatccatccaggttgttgcaaatgactggatctcattctttttataactgagtaggaattcattatgtatatataccacattttctttatccatttatctgttgataggcacttagattgcttccaaattttagctattttaaacagtgctgcaacacacttaggagtgcagatatttcttggatataatgatttcctttcttttgggtgtatacccagcagtgggattgctggatcatatggtagctcaatttttagttttttgaggagcctccaaactgttttccctagttattttgccaatttacattcccaccagcagtgtacaagggttcccttttctctacatccgtaccagcatttgttatttgcctgtcttttggatataagccattttaactggggtgagatgatatctcattgtagttttgagttgcatttctttgatgatcagtgatgttgagtacattttcatatccctatttgccatttgtatgtcttttcagaaatgtctattcaaatcttttgtccatttttaatcaggttattagtttttttatagacgtgcttgaactccttatatattctggttattaatcccttgtcagatgagtagtttgcaaatatcttatttcactctgtggattgtctcttcacttagttgattgtatcctctgttgtacagaagctttttaacttgatgtgatctcatttgtccatttttgtttggttgccttgcttgtggcatattgttcaagatgtttttttttgcccagaccaacatcctgaagatttttccccaaagttttcttgtagtagttttatagtttgaggtattagatttaagtttttaatgtgttttgatttgatttttgtatatgatgaaagatagaggtctattttcattcttctgcatatgaatatcccgtttccccagaaccatttactgaagagtctctcttttccccagtgtatattctttgcacctttgttgaaaatgagcatacctgtgtggatttgtttctgggtcctctatactgttccattggtctgtccattgtcctgtgtatgtcttgaaaagttgtagtagttattatttttgattggttcattatttcatctttctacttaaaataagagaaatttacacactacagtttcagtgtatagtattctgtgtttttctaggtacttactatttctaatgagttttgtacttttagataatttctgattgctcattaacatgcttttctttctgattgaagtactccctttataagtactccttttacaagtactccctttacaagcatttcttgtaggacaggtctgctgttgatgaaatccttcagcttttgtttgtctgtgaaaatcattatttctccttaatgtttgaagggtattttttgccaaatatactgttctagcataaaggttattttccttcagcactttaagtacatcataccactctctcctggcctgtaaggtttccactgaaaagtctgctgctaggcatattggctctccattgtatgttatttgtttcatttttcttgctgcttttaggatccctgctttatccttgatctctggcagattgattattaaatacttgccattttgagtctattttctagatcctgtaggtgtgcttcattgttttttattatttttatttttttttctcttgyctcctctgtgtatcaaatagcttgtcttcaggctcacacgttctttcttttggttgattaattttgctattaaagkactctgctgtatttttcattatgccaattgcatttttcagcttcagaatttctgcttgattctttttaattatttcaatctctgttaaatttatctgataagattctgaattccttctctgtgttatcttgagtttctttgagtttccataacacagcggttttgaattccttgtctgaaatttcacatatctctgtttctctaggatgggtccctgctgccttatttagttcatttggtgagttcatgttttcctggatagtgttgatgctagcagatgttgttcaatgtctgggcgttgaagagttagatatttattgtagtcttcactgtctaggcttatttgtagccatcctttttgaaaggacttgggtgttgtgatctaagctatatctgctttagcagcaccccaagcccagtaatgctgtggttcttgcagacttgtaaaggatcaccttgatggacttagacaagatccaggagaattttctggattactaggtagagactcttgtyctcttcccttactttctcccaaacaaacagaatctctttctgttctgagtcacctaaagctgggggtggagtgacacaaacacccctgtgaccacctccagtatgactgtgctgagtcagaactgaagccagcacagcactgggtctgcggtaaccactccctggctaatgcctatgttcatataaggccctgaggctctacaatcagctgattgcaaagccaatcaggtctgtattcttcccttcagggcagtaaggttccctaggcccaggtggatccagaagtgctatctaggagttagggactagagttaaacacctagcagtctatctggtgttctattgtactgtggaggaactggcactctaaccacaagatgcagttattctcactcttccctcctctttccaaaggcagaggaacctcaccctgtagccactgccaccccaggccataaggaatactgtcagactgactacctccaatgtttctttaagatccaagagctcttaagtcagcttgtggtgaatgtttcctggcctgggactcatccttcagagcagtggactccactctggcccaggacagagccagaaattttatgcaatagtcaaatcctggaactggggagcccaagagcttgcttggtgctctacccaccctatggctgtgctgatacctgaagccagcaagtctcagaggcttacccaatgcccttgatgtggtacctgagtatcgcttctggtttttcagggacgaaaagctcttcagttagcagaagatgaatgctgccaggattggatcctttctctcaaggttatgggttcttttatgacccaaggtgtgtctaaaatgttcatgtgggaggtagggcccagaacaggggccttttgactctgaccactgccctatcctgctatggctgagctggtatccaagatccaakacaaagtcctcccaacttttccctctcctcttctgaagtggaagaaagggatttcttttcgagctgtgagctgtgaagcctgggggtaggggaggggtgatgccggcactcctttatccacctcagctggtgtctcagtatgtcatgtgccccccccccccccccccagtccactgtttcaggacctggttcagcactgggactcacctaattgttgcagaccttatggactacattggctttcaagtttgtttggagacacagagcactttggtcactggtagtgaggtttgcaggaactcaagttctgacctctgggatccatgatccctctctgagtagtgccggtttaaatgcttccctcgtgggcaggtgtcagctgagtytggtccggtttccctttctgctccacctggatagcacaaaatttaatgtctcacagttgctatgttctctctcctctagcacccagagatgctctctgcaccatgccatgacttccagggggtggagaacaggtaatgtcaggggttcagggctcttttttctatctcttcagttgcctctttcagtgatatgaagttaaaaccaggtactatgagtgctcatctgatttttggttcttatgaagctgtttttttttttttttttttctgtgtagatagttgttaaattggtatctttgtggagaaggcaatcagtggagccttctgtkcggccatcttgctccttatacctgctactttgtattctctgatctatgtctcttcatttctccactcctctgttccaaccacccctggtaaccatgtttgtcttctctatttctgtatatttatttacttattttagaatctacttataaatgagatcatgcagtatttttctttctgtgtctggtttatttcacttgtcataatgtcctccaccctctttcatgttgtggcaaatggcaagatctcattcttttttaaggctgaagaatatcccattgtatatatgtactacagtttctttatccattcatccatcaatggccacttaggttaggttgtttccatatcttggctattgtagaaaatactgcaatgaatatggaagtgggttatctttatgaggtgttgatttcatttcctttgggtatgcccagaagmgatattactgggacatgtgggagttctatttttaacttctttagaaaccaccatactcttttctataatggccacaccaatgtacattcccactaacagtgtatacaagttcccttttcttcatactcttactgacatttgttatcttcagttacttaatttttattggtgggaagggggctttattaacatttttttgttgagattattcatttctaattttttgcactattattggtgcttgctacaatttctagtttttgtttcataatttcaacttttagattcagggaatacatgtacttgtcacttgggtatattgtgtgatggtgagctttggggtatgatggattttgtcacccaggtactgagcatactactcactagttagtttttaagcctttgttcccctctctacctccacacttggtagtcccaagtgtctatttttgccatctttgtgtcattgagtacccattgtttaacttccacttataagtgagaatatgtgatatttggttttctgtttctaggttaatttacttaggataatggactcgggctgcattcatgtagctgcaaagaacatgattttgttatttttaatgtctacatagcatttcatggcatatatgtaccacattttctttgtctaatccaccgttggtgggcacctaggttgattccacttctttgctattgtgaatagtgctgcaatgaacatatgactacatgtgtcttttgggtagaataatttattttcttttggatatatacccagtaatgggaatgttgggttgactggtagttctgttttaagttctttgagaaatctccaaactgctttccayggtgggtgaactaatttacattcctaccaacagggtataacattcccttttctcaacagcctcaccagcctttgttgtttttgacttttcaataatggtcataatgactggtgtgagatggtatctcattgtggttttgatttcatttatttgatgattattgatggtgagcatatttttatgtttgttggctgcttgtatgtcttcttttgaaaagtacctgttcatgtcgtttgcccatgtttaatggggttatttgtattttgcttgttcaattgtttaagttccttatagattctggacattagatcattgtcagattcatagtttgctaatattttctcccattcattaggttgtctgtttacttcgttgataatttcttttgttgtgcagaagctcccaggtttaattgggtcccacttgtcaatttttgtttttgttgcaattgtttttgagcacttagtcataaattctttcccaaggctgatatccactatggtgtttctcagattttcttctaggattcttatagtttgaagtttttcatttaaatctttaatttgtcttgagttaatttttgcaaatggtgaaagatgggggttcagttttattcttctgcatatggctagccagctgttctaacaccatttgttgaataaggagtcctttccccattgcttctttttgttgaccttgtcaaagatcagatagctgtatacatgtagctttatttccgggttctttattctgttccattggtctatgtgtctgtttttgtatcagtaccatactgtttgggttactgtagctgtatagtatagtttgaagtcaggtaatgtgatgcctccagctttgttctttctgcttaggattggtttggctattcaggctcttttttaagttctgtatgaattttagaatagttttttttctagttctgtgaaaaatgacattggtagcttgaaaggaataccattgaatctacagtttgggcagtattgccatttgaatgacagtgattcttctaatacataagcatgaaatgttttttcatttgtttgtgtcatccatgatttctttcagcagtgttttgtagttctctttgtagagatcttttacctccttggttagaggtattcgtaggtatttcatggtttttgcagcagttgtaaaygggattgctttcttggttttgctctcagtttgagtgttattagtatgtggaaatgaaactgatttttgtacattgattttgtatcctgaaactttattgaaattgtttattttatatatatatatattattatactttaagttctagggtacatgtgcacaacgtgcaggtttgttacatatgtatacatgtgccatgttggtgtgctgcacccattaacttgtcatttatwttaggtatatcccctaatgctgtccctccccacttccccaccccacaacaggctccagtgtgtgatgttccccttcctgtgtccaagtgttctcattgttcaattcccacctawgagtgagaatatgcggtgtttggttttttatccttgcgatagtttgctgagaatgatggtttccagcttcgtccaagtccctacaaaggacatgaactcatcatttttcacggctgcatagtattccatagtgtatatgtgccacgttttcttaatccagtctatcattgatggacatttgggttggttccaagtctttgctattgtgaatagtgccacaataaacatacatgtgcatgtgtctttgtagcagcatgacttctaatcctttgggtatatacccagtaatgggattgctgggtcaaatggtatttctagttctagatccctgaggaatcaccacactgtcttccacaatggttgaactagtttacagtcccaccaacaatgtaaaagtgttcctatttctccacatcctctccagcacctgttgtttcctgactttttaatgatcgccattctaactggtgtgagatggtatctcattgtggttttgatttgcatttctcrgatggccagtgatgatgagcattttttcatgtgtctgttggctgcataaaggtcttcttttgagaagtatctgttcatatcctttgcccacttgttgatagggctgtttttttcttgtaaatttgtttgagttctttgcagattctggatattagctctttgtcagatgagtagattgcaaaaattttctcccattctgtaggttgtctgttcactctgatggtagtttcttttgctgtgcagaagctctttagtttaattagatcccatttgtcaattttggcttttgttaccattgcttttggtattttagacatgaagtccttgcccgtgcctatgtcctgaatggtactacctggttttcttctagggtttttatggttttagttctaatatgtaagtctttaatccatcttgaattaatttttgtataagatgtaaggaagggatccagtttcagctttctacatatggctagccagttttctcagcaccatttgttaaatagggaattgtttccccatttcttgtttttgtcaggattgtcaaagatcagatggttgtagatgtgtggtattatttctgagggctctgttctgttccattggtctatatctctgttttgttaccactacctgctgttttggttactgtagccttgtagtatagtttgaagtcagataacatgatgtctccagctttgttctttttgtttaggattgtcttggcaatgtgrgcccttttttggttccatatgaacttgaaagtagttttttacaattctgtgaagcaagtcattggtagcttgatagggatggcactgaatctataaattaccttgggcagtatggccattttcatgatatcgattcttcctatccatgagcatggaatgttcttccatttgtttgtatcctcttttatttcattgagcagtggtttgtagttctccttgaagaggtccttcacatctcttataagttggattcctaggtattttattctctttgaagcaattgtgaatgggagttcactcatgatttggctctctgtttgtstgttattggtgtataggaatgcttgtgatttttgtacatttattttatgtcctgagactttgctgaagttgcttatcagcttagggagattttgggctgagacgatggggttttctaaatatacaatcatgtcatctgcaarcagggacaatttgacttcctcatttcctaattgaataccctttatttctttctcctgcctgattgtctctgaagatagaccaatagcaggctctgaaattgaggtaataattaatagcttacctaccaaaaawagtccaggaccagatggattcacagccaaattctaccagaggtacaaggaggagctggtaccattccttctgaaactcttccaatcaatagaaaaagagggaatcctccctaactcatttcatgaggccagtgtcatcctgataccaaagactggcagagacacaacaaaaaaagagaattttagaccaatatccctgatgaacatmggtgcaaaaatcctcagtaaaatactggcaaaccgaatccagcagcacatcaaaaagcttatccaccgtgatcaagtgtgtttcatccctgggatgcaaggctggttcaacatacacaaatcaataaatgtaatccagcatataaacagaactaaagacaaaaaccacatgattatctcaatagatgcagaaaacacctttgagaaaattcaacagcycttcatgctaaaaactctcaataaattaggtattgatgggacatatctcaaaataataagagctatttgtgataaacccacagccaatattatactgaattggcaaaaactggaagcattccctttgaaaactggcacaagacagggatgccctttctcaccactcctattcaacatagtgttggaagttctggccagggcagtcaggcaaycagaaattggttatttgttccagtagtcttttggaggagtctttatggcttactcagtatagatcatatcatcagcaaagagagataatttgatttttttacctatgtggatgccttttatttctttctcttgcctgattcctctgggaaggacttgcagtactctattgaataggagtggtgagagttggcaaccttggcttgttccagttcttaaagagaatgctccccgtttttgcctgttcactacaatgttggctgtgggtttgtcatagatgtctcttattgttttgatatatgttccttcagtgcctagttttttgagaacttttaccaagaagggatgttggactatattgaaagttttttgcatctattgagatgataatattgttkttgttcttaattctgtatatgtggtgaatcacatttgttgatttgcatatgttgaaccaaatttgtawcccaagamttaagcctacttggtcacggtgaatgaactttttgatgtgctgctggattcaatttgttagtattttgttgaggatttttgtatctatgttcgtcatggatattggcctgtaattttctttttaagttgcgtctttgccaggtttggttattagagtaggctgacttcatagaataagttaaggaagagtccctcctcctcaatttttagaaatagtttcagtaggattggtaacagctcttctttgtgcatctggtagaatttggctggtgtgtatccatctggtctggggcaccttttttttttggtatctttttttttgttgctgattcaattttggaacttgatatttgtctcttcagggattcaatattttcctgattcagtcttgggagattatgtatttccaacgatttatccatttcctccagattagctagttcatgtgcatagaggtgttcataatagtcattgaggatcatttatatttttgtgggatttgttgcaatgtcacctttgttatttctgattgtgcttatttggatcttctctcttctgtttgttaaccttgttagtggtctattgatctcttctgtcctttcaaagaaacaacttttggttgcactgattgtataaattttgaggtctcaattttgttcagttctgccctcattgatttcttttatttttctagctttggggttagttttttgtatttctagtgtgatgttagattattaaattgagatatttctaccttcttgatgtaggagttcagcactatacactttcctcttaacactacttttgcagcatcccagagatttttggtatgtcgtctctctgtttttattcctttcaaataayttttttttgatttctacctttattttgttgtttaccccaaactcattcaggataagctgtttaaatcccatgtaatggggttttgagagatctgttggtattaatttctatttttattccactgtggtccaaaaatatggctagtatgatttcagtttttttgaatttagagacttgctttatggctaagcatgtgattgatcatggagtatattctgtgtgcagacaagaagactgtatattctgtcattgttgggtagagtattctgtagatgtgtattaggtccaaatggtcaagtgttgaatttaagtccagaatttctttgctagttttctgccttgatgatctgtgtaaggggatcagtggggtgttgaagtcccctgctattcttgtgaggctgtgtaaatcttttctaggtcaaaaagtacttgttttatgagtctgggtgctcccatgttgggtgcatacatatttagcatagttaagtctttttgttgaattgaaccctttatcattatgtaatgtccttctttgtccytttttactgytgttgatttaaagtctgtttttttctatgagaatagcaaccttagctcttttttgtgttccatttgcatgatagatcttttccaaccctttactttgagcctatgggtgtcattacatgtgagattggtctcttgaagacaacagtcaaatgggtcttgtatctttgtacaaattgccactctgtgccttttaagtgaggaaatttagaccatttacattcaagattgactattgatatgtgaggctttgatcctctcatggagttgttaggtggtggtttgtagtttctattgtttggttgctttatatggtctgtgggctatgtacttaagtggtttttttttggtggagcaagtatatttctttcatttctatgtttaaatcttccttgaggatctcttataagggtggtctagtgttaataaatccccttagtgcttggttgtctgaaaaatattttattttttctttgcttatgaattttagtttggcaggatatgaaatcttggttggaatttcktttctttaacaatgctggaaataggcccccaatctgttctggcttataaggtttctgctgagaagtccagtgttagactgacggggttccctttgtgagtgttctgacctttttctctagctgtctttaagatttttgctttagcattgaccttagacagtctggtgacaatctgcctgggtgatgttcatttagtatattatgtcacaggcattctctgtatttcytttgcttggatgtctacctgtctaggaagattagataacttttcttgaattattccctcaaatgttttctagattgttttctttgtctctctttctctcaggagtgccaataattcataggtttggtcacttcatataatcccatatttcttgaagaccgtttatttttaaaattcttttttctttacttttgtctgactgggttagtttgaaagattgatccttaagctctaaaattctttcttctgcttggtccagagagatggagtcttgctttgttgcccagactggtcttgaactcctggcttcaagtgatcctcctgcttcagcctcccaaagtgctggaattacaggtgtaattcagtgtgtctggcctttggcttacacttttattataatttgtcctgtctaaggtttctttttcatattgttatttttggttttcctctgtgctttcatgttaaggatgtcacttataaacaatgcatagcaagcttcttttttttaacctaatctgtgaattgctatattttaatagatagcttagccctggcatatgtattatagctaataatgaatttaacttttttctgtgattttattttgttttctttttacttcacttgctatatatttctctttacctcctttccagccttttgttagaatgatattttttctctttttttctcattctaatggtttggaagataatgctattctgagtaattattagtaaatttctatcatacaaacttatgtttgttcatctcattttttttgccaaagttcagttattcagtatcctgaccttccccattatttacataggtatctctgcactttctcattttcatataatttgaaatttgagtttgatagctactatgattttattgttctagcctgtcaatatgcttagacaattttaagtagccttcttttcttatcattacctttttaactccactttttctttttgtattttatttttgttttgctttttttttgttgctcttctcattcctctattcattgcatcctctaataattcttttcagacagcatttccaagtggtaaatgatgtcagtctttttctttctttctgtaatttctatatatttgaaatcctgtatttatctaactcttygtatttaccaggttagataaaactaatctggttaatttttatttctatagtaaaatttttttattataccttaagttctagggtacatgtgcacaaggtgcaggtttgatacataggtrtacatgtgccatgttgctttgcagcacccatcactcatcatttacattaggtatttctcctagtgctatmcctccccagcccccagccccccaacaggcctcactatgtgatgttccctgctctatatccaagtgatctcattgttcaattcccacctatgggtgagaacatgwggtgcttggttttcatccttgtgacagtttgctcagaatgatggtttccagcrtcatccatgtccctgaaaaggacgtgaactcatccttttttatggctgcatagtattccatggtgtatatatgccacattttcttaatccagtctatcattgatggacatttgggttggttacaagtctttggtattgtgaatagtgctgcaataaacatacatgtacatgtgtctttatagtagcatgacttctaatcctttgggtatatacccagtaatgggatggctgggtcaaatggtaattctagttctagatccttgaggaatcgccacactgtcttccacaatggttgagctaatttacattcccacaaacagtatgaaagcattcctatttctccacatcctctccagcgtctgttgtttcctgactttttaatgatcgccattctaactggtgtgagatggtatctcattgtggttttgatttacatttctttgatgacaagtgacgatgggcattttttcatgtgtctgttggctgcatagatgtcttcttttgagaagtgtctgttcatatcctttgctcactttttgatgggcttgtttttttcttataaatttgtttaagttctttgtagattctggatattagccctttgtcagatgggtagattgcaaaaattttttcccattatgtaggttgccggttcactctgatggtagtttyttttgccatgcagaagctctttagtttaattagatcccatttgcctactttggcttttgttgccattgcttttggtattttagtcatgaagtccttgcctatgcctatgtcctgtatggtattacctaggttttcttctagggtatttatagttttaggcctaacattcaagtctttaatccatcttgaattaatttttgtataaggtataaggaagggatccagtttcagctttctacatatggctagccagtttttccagcacgatgtattaaatagggaatcatttcccyatttcttgtttttgtcaggtttgtcaaagatcagatggttgtagatgtgtggtattatttctgaggcttctattctgttccatttgtctatatctctgttttggtaccagtaccctgctgttttggttactgtagccttgtagtatagtttgaagtcaggtagtgtgatgcctccagctttgttctttttgcttaggattgattgacttggcaatgtgagctcttatttggttccatgtgaactttaagtagttttttccaattctgtgaagcaagtcattggtagcttgatggggatggcattgaatctataaattactttgggcagtatggccattttcacgatatttattcttcctatccatgagcatggaatattcttacatttgtttgtgtcctcttttatttcgttgagcaggggtttatagttctccttgaagaggtccttcacatctctcgtaagttggattcctaggtattttattttctttgtagcaattgtgaatgggagttcactcatgatttggctctctgtctattattggtgtataagaatgcttgtgatttttacacattgattttgtatcctgagagtttgctgaagttacttgtcagcttaaggagattttgggctgagatgatggggttttctaaatatacaatcatgtcatctgcaaacagggacaatttgacttcctcatttcctaattgaataccctttatttctttctcttgcctgattgccttggctggaacttccaacactatgttgaataggagtggtgagagggggcatccttgtcttgtgccggttttcaaagggaatgcttccagtttttgtccattcggtatgatattggttgtgggtttgtcatagatagctcttattattttgagatacmttccctcaatacctagtttattgagagtttttagcatgaagagctgtcgaattttgttgaaggccttttctgcatctattgagacaatcatgtggtttttgtcatttgttctgttaatgcaatggattatgtttattgatttgtgtatgttgaaccagtcttgcatcccagggaggaatctgacttggtcatggtggataagatttttgatgtgctgctggatttgttttgccagtattttattgaggatttttgcaccaatgttcatcagagatattggtctaaaattctcttttttttgttgtttctctgacaggctttggtatcagtttgatgttggcctcataaaatgagttagggaggattctctctttttctattgattggaatagtttcagaaggaatagtaccagctcctctttgtacctctggtagaattcagctgtgaatccatctggtcctggagtttttttggttggtagcctattaattattacctcaatttcagagcctgttattgatctattcagagattcaacttcttcctggtttagtcttgggagggtgtaggtgtccagaaatgtatccatttcttctagattttctagtttayttgtgtagaggtgtttataatgttctctgatggtagtttgtatttttgtggaatcgatggtgatatcccctttatcrttttttattgtgtctatttgactcttccctgttttcttctttattagtcttgctagctataattttgttgatcttttcaaaaaaccagctcctggattcattgattttttgaagggtttttttaatgtatctatctctttcagttctgctctsttcttagttatttcttgccttctgctagcttttgaatgtgtttgctctggcttctctagttcttttaattgtgatgttagggtgtcgattttaaatctttcctgttttctcttgtgggcatttagtggtataaatttccctgtacacactgctttaaatgtgtcccagagattctggtatgttgtgtccttgttctcattggtttcaaagaacatctttatttcttccttcatttcgttatttacccagcagttatttaggagcaagttgctcactttccatctagttgtgtggttttgagtgagtttcttaatcctgagttctaatttgattgcactgtggtctraaagacagtttgttgtgattgctgttcttttacatttkctgaggagtgctttacttccaactatgtggtcaattttaraataagtgtgatgtggtgctgagaagaatgtatattccgttgatttggggtggagagttctgtagatgtctattaggtctgcttgttgcagagctgagttcaggtcctggatatccttattaaccttctgtcttgttgatctgtctaatattgacagtggggtgttaaagtstcccattattattgtgtgggagtctaagtctctttgtaggtctctaaggacttgctttatgaatctgggtgctcctgtattgcatgcatatatattaggatagttagctcttcttgttgaattgatccctttaccattatgtaatggccttctttgtctcttttgatctttgttggtttaaagtctgttttatcagagactaggattgcaacccctgcttttttttgctttccatttgcttggtagatcttcctccatccctttattttgagcctatgtgtgtctctgcatgtgagatgggtctcctgaatacagcacactgatagatgttgactctttattcaatttgccagtctgtgtcttttaattggtacatttagcccatctacatttaaggttaatattgttatgtgtgaattcatcctgtcattatgatgttcgctggttatttcgcccattaattgatgcagtttcttcatgccatcaatggtctttacaatttggcctgtttttgcagtsgctggtaccagttgtttctttccctgtttagtgcttccttcaggagctcttgtaaggcaggcctggttgtgacaaaactctcagcatttgcttgtctgtaaaggattttatttctccttcacttatgaagcttagtttggctggatacaaaattctggtttgaaaattcttttctttaagaatgttgaatattggccccccactctcttctggcttgtaaggtttctgccgagatatctgctgttagtctgatgggcttccctttgtgggtaacctgatctttctctctggctgcccttaamattttttccttcatttcaaccttggtgaatctgacaattatgtgtcttggggttgctcttctcgaggagtatctttgtcgtgttttctgtatttcctgaatttgaatgttggcctgccttgctaggttggggaagttctcctggataatatcctgaagagtattttccaacttggctccattctccccatcactttcaggtacaccaatcaaatgtagatttggtcttttcacatagtcccacatttcttggaggctttgttcttctctttttactcttttttctctaaccttgtcttctcactttatgtcattaatttgatctttaatcactgatacactttcttccacttgatcgaagcagctgttgaagcttgtgcatgcatcatgaagttcttgtgccgtggttttcagctccatcaggtcatttaaggtcttctcttcactctttattgtagttagctattcatctaatctttcttcaaggtttttagcttccttgcaatgggtttgaacatcctcctttagctcrgagaagtttattaccaaccttctgaaacctacttctgtcaactygtcaaagtcattccccatccagctttgttctgttgctgacgaggagctgtgatcctttgaaggagaagagtcgctctgatttttagaattttcagcttttctgctctggtttctccccatctctgtgtttttatctgcctttggtctttgatgttggtgacctatagatggggtttttgtgtagatgactttttgttgatgttgctgctattcctttatgtttgttagttttccttctaacagtcaggtccctcagctgcaggtctgttggattttgctggacatccactccagaccctatttgcctgggtatcaccagcagaggctgcagaatagcaaatattgttacctgatccttcctctggatgctttgtccaagaggggcagccacctatatgaggtgcctgtyggcccctactgggaggtgtcacccagttagtcagggacccacttgaggaggcagtctgtccattctcagagctcaaccaccatgctgggagaaccactgctgtcttcagagctgtcagwcagggatgtttaagtctgtagaagttgtctgctttcttttgttcagctatgccctacccacagaggtggagactagaggcagtaggccttgttgagctgcagtgggctctgcccagttcaagcttccaggccactttgtttacctactgaagcctcagcaatggcggacacccctcacccagccaggctgtcgyctcacaggttgatctcagactgctgcactagcagggagcaaggctccatgagcatgggagctgccaagctaggcataggagagaatctccttgtctgctggttgctaagaccttaggaaaagcagggtatttgggcggaagtgtcctgtttttccaggtagtctgtctcggcttcccttggctaggaaggggaaatcccctgaccccttgtgcttcccaggtgaggtgacgcccttccctgcttcagcttgccctccatgggctgcacccactgttcaaccagtcccaatgagacgaaccaggtacctcagttggaagtccagaaatcacccattttctgcgtcgatcacacttggagtttcagaccagagctgttcctatgtggccatcttggaatgcccctatatagtcaaaattttaatctcttccatcttatgttgattttatttaaggatgaaattttaaaatatgttttggagaatattatttataattataaaaagtcttgtcctgctcactgtaaattttcttgctttgcatataaatttcttctctttgttgagtcacatattgtttcttcatggtattggctttctctaaatattttatgattcttgcatatcttctgaaattccctattaaactcagaaaagggtgtatctgtttttgcattctgcttggtgggagaaagaggaccaatttttgaacatgaaaataagtagataagaatctgtgccctgggctcaccatttctactgggtgttgacagttgcctgaagcacaactttgtctctctgacccagtgttttgccactctcctccacctgaagaagatttttttttttctattgcttggctcttgggcaggttgaggagagaagagaggagatgaaggatgtgtaggttgctcctgctgtaaagatcygccctattttgcctggcccctgtcctatttctagtttctgctaccttcagacatgaggttactggtgcttctcctgtcttttgtagtttcgactctcttaagtgcatttgggctgtggttcccatctccaattcaatcttctgctttctgccttttaaagtcctgacagtatctcctttttttttgttttctgttgttgagatagatttatttattaggttggtgcaaaagtaattgtggttttggcaattttaatggaaaaaaaaaaacacaattacttttgcaccgacattttttttcttcttttagcttgtaaaggaatttgtaccagaagtggaggctgccctgaatgctcagtccatcatcttgaactggaaccacccttcacttcttaagataattttcatcatgcaaaaagagtgaaattcagtagtctcttcaacatcctatatgtattcttttggttttggctgtgtttttgttttttaaccataactcataaagcataagaatggctaccagaattaatgttaagcagttagcagctacttagggctatagtttttagttatgtttttacagtatatatttccatcctatgttctcttactctagaaaatgtaagataaatctagggctatccctgtataattttagcctcatagaatcttgaaatgaagaataggtgttgaccagttttttagaaacagggtagggggtcttgttctttcatcraggctggagtgcagtggtctaatcatagctcactacagccttgacctcctgggctcaagccatcttcccaccttccaagtagttgggattagagtcatgagccaccatgcttggctccagttttcttatttgtttgccaagtggattgtcttcttttctgttattcaaacaaataaatatgcaaaacagcaaaaaaagttttgcagacacggtggaaatatccaaggagtttttttaaagtatggggttcaatttgaattttactaccttctgaatataccttaattaatattgaaattgatcaatggattggagacatttgttaatgatcacaaaataattttgctgattaggatcaaacacagagtctccatgtaatgatttggaagggtgtttaatgaaagctgcaatattgcctacattgttttcatggactttgctggaagcatctttgaaacttaatggcaacttattattatattcaatggtctaataagacaaattcagaaaaaaattttgggctgatcccctgaagtttcaacatttaaatagtctaggaagtattggtgggtgtgtgattttattcccagatccttaataggctgttaagtaggtggctccacacacacccactttacatttttcttgtcacatgtgattcatttttattccacatttaaaaatccttccgagaaaaatattagataattttcatttcaaagtctaatagtccctgtggctgacattatttccaaggtctcatctcaatattatatgctacaggataaatttattacttttgttctttccttagtggacgtaataataattactactactttttgggcattacttctctgcttgtgatacggctctggcgagtagaggaacactagggctcttgtctcatgttcaattagataaaacaacatggacacacttggagtggttttaaggagcagagggtttaataggcaagaaaaaaggaagaagaaagaaggaagaagctcccctatacagagacagaggaaggggggctccaaagccaagagagggaaccccaagtgaagcagaaaccagccatgtgtatacagaggctggaggaggtggtgtctgatttgcacagggctcgggggattggtttgaccaggcatgtgattcacatagcctgggaaaaagctggccttcccaccctagccttttaatatgcaaatgcagggaaccatgatgttctacagaaattctctacagttctctacacacttggagatatgtgggggtggccatgttgccaggcacatgtggggcaagggcaagaaggcaactcctacaacacttgtaaatatacacgtaaatataataatgcacatgaaaattgttactaaactgtaaagtactattcaaaaatattaacattatttatggtagtattattagcataatatcatgttaccatatcattgatttttaagaactttggataataaaaataatgagaaagtctctctctctgtctctctctcactgtcttttggtgagcaatgcgactcttcccaatatcagaaactaaaatagaatttctttaactttccagctgagccccagaaaacctttcagcaaacaaacatgatggtttcatataccagttggcatgaagataaagtgttggtgctgcattttaaaggggaagtttgagaaatatgaggaaagtaactaaactagaatcaattataataggctggttatcggcaaatatacttttcagaggaacttggagcatctcaaagaaagccaggagtttagcagagtgttctacattctctttctactgtgatagacatgggcctaaacttttcatgcctctttttcattacctgtgaaactggggtcatagtagctttaccgttcttaagaacttgttataaaataccgtgtgtaccccagtgacttatggaaaaataaaataaaaaaattataaaatcacaagacaagggacttctaatgccttgttttcctcaaaaggaaacagtcttaagtgaataagtgatttgtcccaagtcagaaaacctagttgggctataataaactggaagctttttgaattggaatagatgttttagttatatagtatttaaatctttttactgaatcaggaattctctgcaatctctctggcattcattttgagatcactccttgttaagaaattgactgcatttcagggtggaacattatattattggaccactttaattgtctggcagtcattgtttttaatgtcatgtcaagttcctgtgacttctataccttgactcttatcacaagtgtgactccctagaaagcagacacttagaaattagcaagtttatcagggagtgcttttggtatccattctgtgtaaaggaagagaaaacaaataaataaacaaacaggatttgacagagaaagaagtcactctgtagtgcagtttgaatagagtgcctcagtggatgctgcagggaatttagatggaacaaactcttgagctgggatgacagagccaggcctttaaacctctctgtctatcacttactgaaagtaggctgccctgggaagggggcgtgaccttgggtgaaacagctttcttctgctgaggcaattcccaaatggggctgacatgctagggctgtttgtaggcagctaaagctttaattcctttatttctgaaaaataataaaggtgatacctcatagcattcaccacacataatacatttttagaattagtttgtaaatttctactaaaaatattcctgctgtctttaattgggattgtgttgtatctatagataaatttaggaagaatcgatatgttaacaatgttgaatcctcaatccattagtataattatttatttgagtcctctttaatttctatgggtaatattttgcagtttgcaatgtataagccacaaatacttttggatacatttgtgtcttgatgctattttgaatggaatattcaaatttccatttaaaaatatttatcactagtatatagaagtataattactgctttttatgcactggttttatcttctgaaatcttgttaagctcacttactagtcatagtagatttttaagtcaattccttagaattttctatgtccatgatcgtattgactatgaagaaagttttatttctttgtttccaatctgtatgccttttatttatttttattgccaggttgcaatggttagggcccatagtacaatatggaatagaagagccgagagcagacatcgttctgttgatcctagtctagttcaataacattcaatctttcattgagtatgatattagtagattatagtaggtgaattaaaattctagagtaacaacatgaaaaggatgcagtaagggtccattgcttagtaaagtcatacactgtctcaatttaactgcattaatactggatacaacagtagctggaacaagttgtaaataattatctactacctagctttgaaagagagcacattttacattcttatggaaacttttttttttttaatgatgaaacaaccaattctgtagcatatagaaaatgcataatgtcctgcaaaaataactgtgtagtggaaaattatctctttcagatattcatcacttactgttcactgattttcatgctgagaggttcatgcttagactactcttcaaacaagtttatctgggttgaagttttttgcctcgctccctttggacgggaggttgacattttcttattaaattcataaacatatcttctacttatataatattcaagagccagccatgactgcaggaaaatccatgagggtactcatggcctcattcttttaccacttcctctccatctcctcactgcttacataggagctcagcttcctcttaaaatccctttcagagaaccctggaaattttcaggatgttttgctcaggaaaaaggctgctcatgttgtactaattctggcttctcatttccgtctcttagttctgcttctgtgggagctgccctccctgaaaatgtgtgtttctgtagtggggtacgatccactgacgttcctgaaggaagagcagttctttaggtgcctgacttggtgaggactttgtcattgatgccttaaagcatcaatgrtcatgatgagagccttacgtagtctttcatgaagtcagctccttcacctgtcaccatcccatttttccctccacaggtgtcaygtagggaggagagaaggaaattccttggcatcccctttatcatctttaccatttctttgaccttgtccaaccagtcatatcacaaacaagcaaacaaccaagcaaaacccaaatattttcttcttttagtcaaaacacgaaaactaatatgaatattaattcatgcaaatgaaaacctgcaatgatcacccacaaaccagttacaaataaacaaatttggcctcagttggaaacctggctacacagcaatgcctccattgactagagtcagtcagttgcatgtttctattttgcaaaatcaatccaacaatcatttactgaaggctcatagagtattgctctgggggatattgaaatgaatatagataaaaagcaagaatgtaatcttcttaatgtcttctgtttagaatagcttctacttcacaaggcctttttgttttgtcattcattttcaaattaattaaaatacagctcattattttccaggcacaaatatttgctcactatatttaaacatataaatatttaaacacataaatgtccactgctaattgccaggcaattagcagtggacatttgactgcaaatggagtagagctgattgtaacattatatgcaaatgaggagtgctgaatctaatcatgcattgagatttccagacagtaaaaaattataccctctctaaaaacccaaagctttacattcaaaggtctacccaggaataaaggcagtaatggatgtcactacttgtagttatttactttaatcaccaatgccaaaaatgatatttagatgatgattgagaacattagcatcttgtaaatatcaaacatgattatttcctgtatggttcttgaacccctcactcttaagtcaaatattttcttgtgtatcatttttaataaatcagaacaacaagagctgaaatgaagacatcatcttatttaatcattttaaaaataaacacaatagttattactcttatactttataatagcctgagtataatcatacctacttctggagagacagattttcattcataagacagctttctgaaatcctcttctcatttatcaaactggaaggattggctaataaagcagtcaaaatttaaaaatatatatttagtttggttgaactctttgttttaatttaatgagctcatctagcttaaaacatatataaacatgaatatgtgtgtttcattcttccacagaattttggaagcaatacgggcgtaaaaggtttaattcatcatttctttgccacctcgattagaggttttaagcctattccttcaagctgcatgagtcatatcagaaaatatgagaaatcaacatcctgaaataacttgaattgagatttgtttaatggtgggatggagcagtatctcacaaagtgaaagctttttattaacactgaagaaaatacaaccatcatcaggcgagaagattataatggaggttgagaaggataactttggctgtggatgtttccacactgagaaaaaatgtctctgccctgatcagatgctagtgacctgctcatttcctgcatttgctatcaccaacacttcagtcctaatttcatatctactgattggtttcatatcctcctcccccttctcttcttgtcaaaattggagccacttttcaagacctagctcaggattttgctctgaaacccttcctgatcctcccggtttaatttaatcactccttcctcttcttcttaacagcacttcttatctgtaccggtcctttgaccctgaatcatatgctactttatatggttcattgcatttgcaagcctatttgtctgatcttagctagwttaaaaagsctttgagggcagaggctgtttgtttctgtgcttatactatctagtggctgtatagggggaaaaattacatgttgatgatcccaactaatccttttgctccaggatacgtggcttcctcaggacatgccatgcatatgtgaggtctattttaattcataacatcctagatatggctccagagtcagataaacctaaatttgaatctttgatccaccacttattaaatgggattttggggtacatttcttaatttctgtaagcatccatgtactcatctggaaataaagggaataataaaattgtgaggatgaaattagataatggctaacaatcacctggcatggttcctggccaataattagcacaaaatagtggcaattattattactatgggtgttgaagcatggtggaccctcaagtggctctggtagtcggggaggaggattgcttagagagtgcacagagtgctggactctatcagccagtcatcaaaatcgcagggccaaacacaatgcagtgagctcacacttaatgtagggcagtgtcaggagagaggcaaagtatgaatgagaatcatgccaacaagagtccctaatggtaataatactagaaattaggcatctggcaagtactgtttcgaggtggtcttttcagtttggttgaagacattgaacagcatctaagatttctcaaaacagaaccagtttttctgaaagggaggctagggaatgggtaggcagggttttaggtgctttgttgagtagatgagagtttgttttgtttcatgttaatgctttttcttccagcaactgcccaaagcccctcttcctcatgttggggctcagaagctgataccccaatacatggcgctttgacatgttgagttgaaggaaaagcctcaggtctctttgaccttcccctccactcccgatattctgtcttccccaaagcacagggtgaaattgttctctgargttccttgatctgcctaaagtctggaactgccaaagaataaaacaattacctctgttcccttccctgagtttgtattaattgaaatcacttttagggaagaaagattgaagtctgttaacacgcctggacagacttttgtcataaaccattgtcttctgcttcagtcccattcagtattatatagaaccatttaccagccattgtctgctctatgggyccaacagactttgtcccaggccattgtatattcttcaagcccattgaattcccctaaaaataatttactactccccccataaaatcatccatatttcctcatctcacattatcctaagaagaagggtagataaccacttgtaccccactgggtgttggggtgatcactctgtgatttctcccatgcatgttawtaagaatttatatgtcttttctagtattaatctgccttttgttgatttttttgcaaaactttggagggaaaaagggaagtttgcccttcacccctatacttttcttcttgtttgtagagtcactgactcattgttaccattttcttatctccattctcttaccaacccaatgcaatagagtttctcctacaggtcctctgaaatcactccagccaaggacattagtgtttttcttgtttctgactctatggattcattgtcatcttgtctctcaacagcatccaaatctatagaccactctgttattcctgagtttttctctgcttttgtctgctgtcagatcaaacataatcacttggtattcttttttggcttctcctactcactttccccaccaggttcctcttcctcctgtcaattaattgttaatattcctcacaattccctctttgtctctgttataactctacatcctctcctttagtgatgtctctgaccctaccaagtagtaagcactcagccgggcatggtggttcacacctgtaatcccagcactttcagaggctgaggtgggcagatcacttgaggtcaggagtttgagaccagcctggccaacatggcaaaaccccgtctctactaaaaatacaaaaattatttgggcatggcggcacatacctgtaatcccatctacttgggaggctgaggcaggagaattgcttgaacctgggaggtggaggttgcagtgagccaagatggcgccactrtattccagcctgggtgaaagagtgagtgagactctgacacacacacacacacacacacatacacacacacacacacacaaagtagtaagcactcaggagttcgataaccacctttatgttgatggcttctaaatctctgatatcagtccagatccttttcttgacctcaactacagggccaactaactactagatttctcaaacactattaagacagaactcttcacctctcccaggtctccaaatttattcttcctctcctgttccttctctcagggaatgacaccattatccattctgttgttattcaagtaaaacagactcacatccttcttgacatttcatttttttatatccaattaatcatcaaatttctactcaagcttcctkaccctgttttcctcttctgggtagataggtcttgtttgataattcatctgcaaatatatagactagagtgcttacttaaaaaccgctctcttgtttttcttttcatccacctgttaccacatagcttaatcagttttgccacatccctttcagtgtggacttagaaaatatacccccaaaaagcttcagtttcaattagctgggcgtgatagcacgygcctgtaatcccagctactcgggaggctgaggcatgagaattgcttaagcccagaggtggaggttgcagtgagccaagaatgggccactgcactctagcctgggcgacagagcgagactccgtctcaaaaaaaaaaaaaaaaaaaaagaaatgaatgygcatatgactaccatcctaatataaatggagcttatgccagtactatttgcagtagtactacttgaaataatgctcacaataaattttatgcttattaaatagtaattatacataatatagaaagtcaaatagtgctacaaaacttacaataacaacactcattaacttgacccccttccaaatctgatttttttacttctccaaggcaaccactttcaattcttttagttacactttcaacacttctattgttgtctccttatttctaaattaaatgcttatactgtgacttcttgattttaaactttaggtattatttattgacttcctgttttgagagttttgctttcttataccacwcctccccttgcctttcccccctgattaytcctctctccatcttcctaatagatttacatataatttctatttacgtttagaattttcattaccatgactatggctagagctgagccctgtagtgtactacatataataacatttttgttttactacaaatgcttttgcttttcctggagttaaaatgttcttattttaatgtgttttcttacatttctttttacctattactaaatcagtcatatgctttgcacaagcactataaaaatcttctcagtatggtcaggtttttttcttttttcttggcgaattcctcctagaaatctctatctgactactctaatcttaactggttacattctaagcctgctccacagctgttgttttagacacttatattcactcttttttggaaattccctttaccrctctccttggttctttgtaacattactggatttcctgaatactatttcttagattccatcttatttgttagagcacattctccaataatttcctgagaaaggggttaggggaaataatgttttgtagaaacttgcatgtctgaaactatgtattatattgtcacatttgattagctgttttgccagacattgagttttaaataaatttttttctgaaaatttaagccacttttccattattttctattttcagagttgatactgagaagtctattaatgcgtggatttctagtttctgtgtataatttatttttttctctctgaagctttcaggatctttctccttgatactctaaagttttgcaatgatgtaatatggcttgagtctttctaaattatttttctgggccctacttggatcatttaaatgtggaaactcacatccttcattttgaactatattcttctattatttattccagaattgtttctcctttttttttcttctcctgatcctttcattctattttctgggtgatttcctcattttattgtacaacttgtctattaaatttttgcatttgcttctatatttttaatttcaaagacctttttcttattcattcattcattcattcattcaacaatatttattgaataattatgatatgccagggactaagatagatgctggagatagacacaaacccctgcccttcagtatcttatcttctaatggttgaaggcaggtatgggattgcaagtaccaaaagatgggtgatatcaattttttgtttttttgtttttttttgagacagagtcttgttgttggctggggctggagtgcaatggcaggatctccattcattgcaacctctgcctcctgggttccaggaattctcctgcctcagcctcccgagtagctaagattacaggcatacgccaccatgcccggctaatttttgtatttttagtagagactgggtttcacccagtcaggctggtctggaactcctgacctcagctaatccatctgcctcagcatcccaaagtgctgggattacaggagtgagccaccatacccagctgatattacattttaaaaaggagagtctgggtaggcctcattgagaatgtttgatgatgcttgactgctcatcatatttacaaatgmggtatgaaaaagtaattggaagcactttgtaaatgtgtgcatgtgggggatggattgttttgtgaaccattgggccttaccatagattaattgagcatttaaccacttctttgggccctttgccttgaactgactgctttctccaggagaagctttattctcctgtctgaaacatatgtgccagactgccagcattctgragccaagtcactatgtagatcatctctctttttatttgagacaaggtctggctctgtcgcccaggctggagtgcagtggcatgatctcagctcactgcaacctctgcctcccaggccaatgcyatcctcccacctcagattcccaagtagctagggctccagccacgcaccatcatgcccagctaatttttatattttttgcagagacaggatttcaccatgttttccaggctggtctcaaacccgtgagctcaagtgatccacctgccttagcctcccaaagtgctgggattacaggcctgagccaccatgcccagtcaatatgtagatcacctcttagttatgctgtttcttgcagggactctacttgaacactcagttgtgattactgtccctgaggcaagagcctcttcagctttatttctcctgagattgaatccccagttttattccagaatagtgaagaggcagctatttgacagtctgggcttgggaagaagacacagatgtataactgatttttatacatatactgacatttgaacagtcttctttttgtcagctctgacccacacccattttgagagttatagtttcctggtggctctgctgtctgaactctctagggttctgaaccacgagaggcattacttccctctgacaaccaccatttcccccaaagctgatagtaggcttttagctttctcttttctgttagctactgctcatctacccacacttcatcttacaaaattttatcaacatctgtcacctactagtatctctgaactcatgtcttttgttttcctgggtttataccaatttcctttgcttttattttagtggagttttggaggaagacaagataaacctgccctatttaataagaagtccaaaataaaagacttaatccaaattacttgaaaacttttctgaatatatgaaataaaattttcattctcacaatgagaatagtctttcattctctatgaattctccaaataatttagtgattaagaaaacagatctattttcttaatatttcataarccttttggttacatactaaaacaatgtattaatattcttatacggtaatcatatttgagttggttcattagactttattttaacattatgagtaatttttttttttattagaaagtcttttgaattgtagggcataaggaatttttagttgtgactcctaggtctaacatttaaaaaaattcaaaacacactgtcttagcaatgttactagaattaatcaaacgctaaaattttgtaagcctgactccatagaccataaaatattggaaagatcacttgctatgaagtcaataaacttggaatttaatctcaactataccactggctacctgactttaaatgaaatgaacacttttgacctcaagttcctaatctttaaaatggggcttaaactagttggcctaataccaatattgaatgattatttgayagttacatagaaatagattggatgtagaaatagagatatgaattgcatggtgtttgctcactagaatgtggaaaactgtaaaggatgcatgaatatcaagcaaagagaaataagtcacataggttgcctgccattctttaatgcttattttctttcaattttttctttttaataatcttactaaagtgaagctggggctgttagtggtggcaaatccrtatgggyctgcagcaaccttacttcttgcctccttagaagaaagaattcaactgaggggcattaggcagagggagaaactgaggaaagttttagagcatgagtgaaagtttatttaaaagctttagagaagtaatgaaattcctttcattacttctcaagccggcgacttgagagatcaagtgcactgtttgccctttgacttggggttttgtatgttggcatgcttccaaggggttgcatcccttctccccgatttttcccttgggatgggcagtctacatgagcagtggcctgtcagcaattgggaggggagcatgcagtgtatgtactggtgttgtgcacatgctcacttgaggcattcttcctttaccagtctaatgttcctaggaggtcatctaccagttaaacttaccatttttgccttttagtgtacatgcttgagcccacttgcccaactcctgagatcttattgggaagctgctgatcacgagtttcatactttttcctatctattgggagactgcctttccttggtgccagttgtgaccaattattattttagagaggcagtttagccaccaccagaccatcacatcatagttgcctgacattcctggtgactggggggaccctcacctgctctggttatgtctgcctgactgactactgtaacagggccaggtcattttcttgcttaaacatcttactatagtccataggataaagatcatcactcctactcatgacatatgcacagccattgccagtggtttcaaaaggcttgcacatcacgaaggctcaataaatgttattgatttgaactgaacagtaaatagatcamgatggtataactgccttttagtgctcatagccaatgttctaaaacattctcctggtctatttttttgtctggctgccgtattgctatgatttctaaaaaaacccatagttttctggatcaggaagacactttactggtgggtcaggttatagagatcactgagaatgaagattttagtagtaaaatgatgtaaataatctaaatacaaacccttctactgctaaatcaattagagtcttttcccaatccttagagggaaaaaaagttaatagatttgctgaattttaactatttctctcctttatttttcatatcttttggatatttacttgattaccagggttcaagcaaatgattctcaatttgcttgaatcattgttttagatttattgtttagaataattgttttagattgtttatttcatgctgctttctgtgtgactgctctaggaacraagtcatgagtagaagccagggaggcatgaaagaaaaagtcttgtggcacccacaccgagaagatgctaagcagagatgtgaggaaacaaagctgagaattgagggacaatccaagggaaagaagtggactgggaaatsggttctcctggcctggaaaagacacgtcaccacagraaaaaatctggctccagagaacaatttattttaatatgcctcattttgctatttcattaattcagaaatacttggcctttttttctactgttactgtggaggcataataggaaatgtaaacatactggtacaaaataagaaataacttatttatatggcaggaagactagaaaaatcacagccattttcttcttcttactataagctctaattttccatgatactgctctacatacaggatctttatttaaaaaaacctgaagtgatgatattacattgccacatcaacatttgaaattaaatgatcaatgggtgatataaaaatggccagcacatggtacattttgtaatactttaagtcacattgttgagatccttgataaagatatgatttgcttttaatctggcaccatcatttattttgggcaaagctagaaaacaaataacataatttgcataatgaaaccattgagagaaaaatcactgtaatttgtcagaggtatctgcaccattttgacttacagtttaaattcattcaagtttatttctttccttaccccaactaaacaatgcttttgatttattcttgccatttagtgtcatataaaataaagtgttccactaggaggagaaataatttgtcaagtagaaactatattaaatgaaacattctctctgatatgtttttaatttgttttattcccattttgctattgcaattttcccacctgccaatggagataaggggctgtttcattctttctcttttggctcgcgaaggccacacgcttgttttgttaaggagagtccacctatcaccaggagggacagaagtcagctcaggaagggagaccctgccagggractcagccatgaggtaaggccagccatgagtccaaagacaagtattcctgagcacctgaccgctatttatcaaacattgttctaggggatgtggggaattgtaagagaagctcaagacagtgttcttgtctgggctgatgaaaccttatcctaattcaggctacagtgaatactttatgtgcaytctgagtgttcctatcctttccttgttatatggcaggagtttttgatatagggtacatggaccccaggaggcccttggatagaacacaagtggtaaaattccatcttttaaataattaactactaactgaaatttagccatttcttcaattatatatgttggcacaaaccacagtagtattaagagtgtctctgaccttgtcagcagtagaaaacactgatatttttatataatatcacagttgttgcagatatcttgraacatcatttgtgctttatcactatttttgaaaattatagtagttattagacctgcagctagagtttgttacttaatgcattcatatagaaagacatcattaaatcacatttttctggatacttttataattgtacttcaatgcaattggtgtcttttgtaatcctacgtattttctttcatacattcaaacactcatcggaggagtggcccacagaccttaacagttggccaaaggtgtcagcaatacaacaaaggtatcgaatccttatctatgatgatcagattaggtaatttctttattcacttatacttctaatagaaaaagaagagaaaaaatgaaaaaaagtaaaattaagggtttaatttcaaatgtttggtggggtggagttgttgaagtggttaacagcattgaggcttctgagttagtagaggcttaaaatttttcctttatatattcattatttctggtaattgagttattcagcatctgacctttaccgtcttgataatatttctgtctgttgtttcttgcgaaccttttctcgaatctgtcagcttgtgaccttggaaggttacttaacaccccctgccttacttttcatcattttctggttggagctaataatgcttcgtttgatgttgtatttttgtgtgtgagatcttttgtttgtaagatcttaaaagatattgacagtatttaattgaataagaatacatttgtaggcatttgaaactctaatgccttatataaatatatcaatgcaatgatttattattacagctgttatgccatagcatgttgggttgctgacaattttttatttttttttgtgacgaagttttgctcttgttgcccaggctggagtgcagtggcgtgatcttggcttactgcaacctctgcctcctgggttcaagtgattctcctgcctcagcctcccragtagctggaattataggtgcctgccaccatgcccagctaatttttgtattaatttttattattaattttatatttcaccatgttggccaggctggtctcgaactcctgacctcaggtgatccacccgccttggcctcccaaagtgacggtattacaggcgtgagccaccacacctggctgacaaatttgtatgtatgtatgtgtgtatgtatgtatgtgtttattatttttgagataggatcttgctctctcactcaggctgaagtgcagtgatgtgatcatggcccactgcagccttgacctcctgggctcaatccttccttctgcttcagcctcctgagtaacttggaaaattggcatgtgccactgtgcctgactaatttactttttgtagagacagggtctcactatgttgcccaggttggtctcaaactcctagcctcaagcaaccctcctgcctcagcctcccaaagtcttgagattacaggtgtgacccatcacacccaggcaacaatttttaaaaagaaactctaatccctcaactatatcattgttgggtaaggaataaaacataaataacgtcaaaagggggcaccttatgattatttctcatgggaacatggtgcttggaaatgttatacctctcaattttctaggatatgatgtgctgtcatcaattttttcttaaacatgcctctgacatggttaatagcacagtgcatttcctgagagttagggtggatggtggagtgaagggtcttgttaacatcatttggtgtacccatagtgatgctcccttgaccatagtttcttctcagtagttgaaggaattgcaatcatttccccttgcagagctaggaacatatgctggtagtgttaaggaacattttggtccacgcatcatcttcatttttgcagacagcatatttttaatataaccaagagtccaaaatatttcaacaagtaataaatgtaaacttttctaacaccttttattacatactgtggccaaaatacattgaagaagtagagtacaaattttgaaaagatggctgtaatgtgacacctctcctgtcatttaaatcaatattgcagctaatatatattaactttaggttgatggtgattaacccagcaccctccatgtgccaagtgttctatcctggcttttattagttactgcttaccaacatccattggtggtgctactgttcccatcttgatttgttttgagaaccttgaatatgagaaacagactctccaacctgctttctcttacaaaatcagcaggcttggggagcaatatttaaagaacacaaaaactttgatgcagacagtaaatatttccttctctccaagaaatttcatagccagcatccttatttctttgttagcatcaactgtggcattaatgtagcatccccagcctcacgtcagtgtttggagctcagttgaacaacagagtaggtggaatgggctgtgatttatgtgtatcaataagctcataggccccacccttgcttagtcaaaatcctataattagtaactgatatggttttgctgtgtccccacccaaatctcatcttgaattgtagctttcttattacctacgtgttgtgggagggacctggtgggaggtaattgaaccatggtggtgggtttttcccatgttgttctccttgatagtgaataagtctcatgagatctgatggttttataaagggtagtttccctgcacacattctcttgcctgccaccacctaagacgtgccttttttgctccttcgttttctgccatgattgtgaggcctccccagccatgtagaactgtgagtccattaagcctctttttctttataaattactcagtcttgggtatttcttcataaccgtatgaaaatggactaaaatagtaaccatctctggtgacgcctttattacagactttgcaattataagctattccttaagccacagaaagaaatgaagaaaggaagaggggaagacagaaagaaaacaattatcacttggtttagtgaccacgtgtgttgaggacaggtaaatgtttttattgtaaagccatctaagacccaggcattgggaatagggcatggttaataataattaacactagggaggcagctgacaactttggcatttagaggctcatagaaagaagaaagctcaaaatcatgtgttagcttaaaagagttgggttttagcctcccactgattctgcacaatttagtggcaagatttgaaaacaacaccaacaacactgctatctttgacattcatggaacaataaaaagtaaacacccagaaggtaacaagcctgggagatattaaccgagggatcccatggtttctcacttttccattcttccatgaagtcactgtttcacatagcttggagtctgtgaaccatgccaatatatgtgtctttttaacatggttcattttttaagtacatcattggtttggagagatgagaatgagaagatgagttaacttttattgtgaggcaccygtatggtttagactttcactgcaactttgttacaggtgagcgatatgcccttcatttcacagactctgtggggtgtccatcagcacatgagtaaagatcttcctttggagggtaaccactttctgacattaactgtgtcttgatggagaacacagcatatgagttatgagttttggcctgcgagttgtgaaagatgactcggaaaatatagccttggagaactaactcagaaaactcctctggcagcactaagccataaacagactcagctcatttctaattttggctcctcctcagatgtccaggatgacacaagccagccgtcaagcccatttctaattgctcctgttgcaatgtgttgacatctcttgtcttctttgtgaaaacgtgtgggatcatttagatgagagtagagataggaaaggaaaaggactagtttgaggcaacctctatgataatgaccagaaaggggagcaaactgaatggagtggagcaggaaggtagttgagaaagggtattagtagaaggaaagaatttggtgaaacatgacaatatttctgaagagctctagtagtaaacgcttgatgaatataggaaaaaaagaccatggtagaaaatccccacaatgcaatagagatggtaaaaaaagggaacagagcagaaaatatgaagtgtttaagattaagctaactaatagttctatgtcaatgctaatactcatgttgttctcccactatttgcatatctttctaggaatagaaaaaagaaggtacatgtctaagaaggatttaaaaatgtcaaggaaagaacaatgagatgagaaagattaaagtcagaggtgagcatcaggacttaaaaaattttttttcctgacaacaaggttattcataaaatggaaaatgccatcttaaatgctatgttacagaaataatgattgtgggatttacatatttagacccacaggctattagagctggaaagagcactaaaaatcatttagtctacttcttattttagagacaggacaaaaggcttggattgttattctcagggtcacaaaagcaattaacagccactcaggaacttaagtataggtattctggttcttagtctaggactaagaaccacagcaatttctttcctttctcataaatgtgatgattaaaaataaaggtcatgtagtttattgacttgcttgggggaaatcaacacattagaagcaaacacatgactagaacaagagtctcttgatttttggttcagagcataaatttgcttgacatgaaactatcaatggtttcatagattgagtttcctgaaatgacataaagattaatgagcaggaatcttattaggtaattctcttggaaacagtacttatagaatggaagaggaaggagcagaattgggaagaggggaaaagtgggctgtgatgcagtctaatcaaagtcataggtaatcccagaggaaagtctgagactggatggctcttggggattgtcatgagttggggcaaaggggtcagtccttcataaccctgagatcagtctttatttgctgcacccagggagaagccatgaccttgagcaargatgcgcttttcagccaggacacttaacaaagagggctgacagctgtcagcacttccagaagctggtaaaataagaccttcattcttaaagggacatcttggcagaataccaatgactattytagtccactgcttataccactcagatacacatcttcatatacatactgaaaatcaatcttctaggatcttagtaggtttcttttgctggcagaatgttgtaagattaaggttgataggataaactggtacccttgcagaaacagctagttgcaagatctcaaatgatatttatcatctctcttcttcactatccactttagattttcctcatcatctgctggtcttggtggcttcccagtggcatggtggtgaccatcctgagctcctggccaccctgtcctcttcaagccatagctgcacttgtccatttatcatcaaacgtaggcaaatagaccacatgggtgccaaacatatttcttcgtgctccccattgtatataagaatgctactttctttcagggttaattgctaccaccaagatggtgactctttttattttaagctggtcacttgctatgaggaacctgaaatgcccaggtgtcagccaaagcttatattacaactagaattttcctatgtttcctggtggaagcatttcytctttggcttgaacttcaagccatgcagctccaagagttgcaggtatgagaagcacaaatttcccaagtgggtcactgtgagtggtgataagtgggaccactcttgcttccatatatcagttcctggatccatgtattcaagcacctgggatacaataccatataaagatcattgatttagggtgtacagtgtatttgggaggttagagccccacattgacaatgtcatcttcaagctggcacttcagctgtgccttcaacgggccattccgttgctccctcagaccagcaaattttggtttgtgtggtatgtggatacaaatcagtgatccagtggtcagccaccagatacccactcttcaacctcctttcttcaatgtgaatctcttgatctgatgctgtatcatgtaggatcccacactggtgaaccaaacctctgtaagtcttcaagtagtagtgatggctgaagtgctatgggcagaaaagccaaacccatacctagaacatgtgtctattcctataaaaatgaattactgcctcttccaggatgaaaagtccaatcaccaagggactgtttggtctcctgtagagatggtgccattccagagaatttgtattggtctccgtctctagcagattgcatatttgattggaccagtcacttatcagcctcagtaagtggagggctatcctgctgatcctatgcaaaacttctaaccctgaaaatatagccattttatttatatgagtgttgtgctagcactagggaggctaatgagaaagacttgctgatgtgaactggccagctcatattgtctagcttgttatttcgtgcctcttccatggtaggtgctttctggtagatgttaacatttgatacaaaaatctttatatttcactcccattcctataggtccatgcaaatccctctacctcagaccgtatttttctgtcctttcaattttattttttcttaccccttaacctcccagtcaagccatttgccattgctcatgaacccatgcacattctaactacaggacacttccttttctatgtaaagagctcaccacatgcactgccacttgtcactgttgttaagggccacctcaatgtcaggctgtgatatagctttcatccatttcctgcttgcacacacataccaagccaacccatctctaaaccaattttttttttgtttttgaaawtgatacataataattatatgtgtttatggggcacatgtgatattttcatacatgcatgcaatgtgtaatgaccaaatcargatatccatcaccttaaacatttatcatttttttgtattggaaacattccaaattttctcttctaactattctcaaatatacaataaattatagttaagtatagttatcctactgtgctatcgaacactagaacctgtccttctaaatgtattttttgtacccattcatcaaccacttttcacgtcctctttcccaattttttccagcttctggcctatcattatgctctctagcttcatgagatcagcatttttaactcccacatatgtgtgagaacatttgatatttgcctttctgtgcctgggttattttatttaacataatgtcctccaggtcagtccatgtttctgcaaatgacagaattttattctttttatggctgaacaatactccattgtatatattccatttttttactgagcatattattataaatcttctttattttaaatttagcacattgtgctttaaaattatatccaagtaaaaccatatattcaactctttgttgtttctatacagaagtgtaaatacaacattactttttgtcactaagttgccttaataagttttacaggaagaaaaacattgaatgagaaaagatggcttaaattatatgtggcaggcctgtgaaaccatgcaatggatacggtatgtgtgtgtgtctatatatatacatatatatatattgatattattgatcttgagcatcttttcatatacctgttgcacatttgtctgtctccacatcctcatcaccatctgttattttttgtctttttgctaatagtcattttaactgtagtgaaatatctaattgtgttttgatttgcatttccctggtgactattgaacttgagcatcttttcatatacctgttgggcatttgtatgtcttctattgagaatgtttattcagatcctttgcccactttttagtcaaattattactatttgttgttgagttgtttgagttccttgtatattctatcaagctgttgcatcaagctatgcagaagcttttcagcttgatgtaatcccatttgtctatttttgcttttgttgcctgtgcttttgaggctttactcaaaaaaacccttgccaaaaccaatgtcctgaagcatgaaatttggatttttatcctcttctgtttgttggctagaagggattcccctctattttggtaggcataagatgatggtcaagagctataacatcaatagtggatgacttcaggacctaagctacctgctcatgttgtctgtttctgttaatgcttaatcctgaatgtgctacttttatctcaggatgttaaggtcctggacccaccctgaggtctgatattacccagctcaaaatgagcagttcaggcttcatggttacttggtgtccataatcagacactgcacttctaccaggacccagtagcaaaccaggacctgtttttcaaaagatgtatctgctgtagatggcacagctttactctacaaccctaggcatctgcattttgattctcccattgggctttcaacaaacaccacatggcaccttttcctaccatagattaatgctatgtcatactggtagtttatatcactcaagggaagggtcactggcaccacagtctgaatttctatagattcttttaatgctttggtcattacttaaagttagcagtctttcatgctacctgacatatgatttggtgctgtattcctgcaatggaatatgctgcctccagaacatgggaacgcctactaggcaaggtgcttccttatttgtgatagaaagtgcaaattgcaataatttktattttctttggaagggatatcccaaaatactcaaaaccataggacttctaaaaatattactaatatatcaggccctgaatctctatagagtttatctcttatcctctagtgtgtatatgttttacctaggcctacaatgtacttgtcacttcttttttctagttggttcaattgccatgacatcctagatatagtggactaatgaagttttctgtgatatcctagtcatcaagatctcttagactatatagcaactgaacagaagagttaacatagcccttggacaaggttgcaaatgtatactattgtccatttcaagtgaatgagagttctttctgattgcttttggtgtggttagaaaataatgtatttgaaggatgaatggtcacataccaggtgcctgaggttattgtcatatatactagcaaagatgccatatttgagctagtattgcttggttgagtttgtggtatccattgttattctccaggatacatctttttttttttttttttggtgggtgggggtgcggggggtgagtggttgaactaattgaattaattggagatacaatggggctcaccctcctccatccattaggtctttcattgaagccattaaatttctgccaaattccaggaagacctggaatatgacagtttattagagagtaccctggaaaaaatagccatgaaagtraaaaaaaggaagcaagcttggacagaagaaaaaactggactgaaatacaatctcagtgagtaccataactgatctctagagagctcttggtgtgcattggccctacagagctgtcctgagctaggtgaggagactggccttgatagtcttgtattgaccatttcccagatgcgtggtcaaggcagttctcttcaaccaaggcacttccaaaagaggttgatagctgaggactctgctggaagcagttccagcagctgggagaaaaggtctttcattcttaaagatgaatctggacagtgtgtccactaccaaatgaaatatgggatctcttatataatgtgataggaacctcaaaattggaatcatatattttattttttttcaaagtagaggctttcaggagcttttagtatatttgaaatgaaggataacaaaatagtaggtggggaagagaaaaagaaatggcctgccatactctaattatagaagagtacctctaactattagcatattgaacagacaccgaactcagaggagaatggtatttgtagactgataaatgagtctggaataaactacttcccagaaattgcctaaatgtagctcaggctagcgtaaactagtcaccccaggctggcttccttgtttcactgaaaaacaagtggcacttcatattatggaactaattgcaattggagtgtattccaatatattcttgagagccccaggtatacctgtgaattggaattcatccataatcagtaattatgctcttctatttaaatatttgatcttgggcaagattttatgcaattaaaggtatgagtttggtgtatattgttatacttaatgtcttattttatttaaaatatgaaaaaatgaatttaatcagaaatttcaaaaatgattccttatctgagaggccttctatgatgtcatttaaatagcaaattccttattattctctatctccttactcttttgtctttgcttttgtcactaatatataatatacagtatatttttaatggaatgactatatctcccatctctgtttggagtgtgtttcatgacagcacagaatttatctactttgtttattgcaatgttgctaacctctagaacatagtaagtgctcaaaagatggtgcctaaaaggatggaccaagtgttacacaagtcatattctatttggttaatacacttctccacttctgagaaacatattattgttaaagttaaggtagattaattatgttaagaataaatggtctgggcatggtggctcatgccctgtaatcccagcactttgggaggccgaggtgggtggatcacttgaaatcaggagtttgagaccagcctggccaacatggcaaaaccccgtctctactaaaaatacaaaaattagctgggcgtggcggtacacacctgtagtcccagctacttgggaggctgaggcgcgagaagcactcaaacctgggaagtggaggttgcagtgagcagatgttgcgccactgcactctagcytgggtartagagcgatactccatcaaaaaaaaaaaaaattaatggatgcttttggcaaattcaggactgaaaattgctgtgacttttcctccatgagagtttctgcagtttgggtcataagagttaaatatggttaatacttcattaagtactgtttaactttagcaacctaagacattacatgtcatcaattgttctgactttgtggcacctgatagctactatgctactgtggcattgatgatgttggcggtgatgatagcgatgatgattatgatgatgataatggtaatggtggtggtggtggtaatagcaggttaatattcactgagtggtttttcactaattgtcatgctgaattttgaattcactgacttatgtaatgctcactaagacattataaatacagtttaccattttaatgataagaaaactgagacatagagaatgtaatatccaacctggctggttgtggaaccagcatttgaagtggggtgagacttataccaaagactgcagatcttaactattctgatattctgagcagtggcaagcagagagaagggagagggaagtgataaaatttgaggaaaataaatcccacactccctttcaaaattgtgagtggagaataggagggaatgtttgagagcagtccagaaacatcatttaaaagcaggtaactataaggcagaaagaaaaatggcaacatcagagcataatacgaagattcatgggaaatgggagcagaggagaaggagacccagccttctggggaagacagtgtaggattagagaggaggctgtatttcagctgagactgaggaggggaggtaagacctaccagaaagaagtaccaccaatgtaaacatatcatcaraagtatgttgtgtaatgtatctaagcaatgtagtaaaaaagcgtagtggttaaactttactctcctaggatattgcggtatattttatatttgctatatatagtacatagtagtatacagaatatgtgtatatgtatatgttactacgtaatatacatatactactttccaaatagtatactgcagtacactgccaaaagtaatacaactgatgggcctaaaacaaaacacatttctttcaagggatttgtcaatcaaaaatagtgaaacaatagtaatgcttcattcctctcaacaacccacaatcctcatttctgtatatcctttacttacacagattcaccaactgtttacattttccacatttgttttatcatacatgtatatatataattattattatagctaaatcactaaaatgcttgagagtaagtttcagacttaaagactttaccacaaaatatctcactgtgcattttctaagaacaaggacattcttttatctagccaccatataactattaaacttgtacaatttagcattgataaaaattatctttgaacatacaatccatattcagattttaccaattatcccaataacattctttataacaatttctcctagtccaggatcaaagccagtatcacacattgcattgaattcatatcactttaatcttctttaatttagaagatttcctcagccatttttgcttttatacattaacattttgaagtgtataggccagttgttttgtaaaatgaaactcaatttggatttgcctatttcctcatgtaaattcaggtaggtagttttgcttaggaactatgtatgtgatttatgtcctctgtgacatcaatggtgtcacagatattggtgatgttaattttgatcactagattaaggtgttatctgtcaggattctccattgtaaacatgccattttccctttaaaaccaaataaactgtggggtgctaccactgaaagtatgtaagtaccccaagaaatcttcactcaatgatttcagcacccattaatgattcttgtctgaatccattatgactatatgattaaaaatttttgaatttttcattcaatcctttcatatattttagttagcatttctctcattgttttgtgagcaatttcttactttttggcacagtaaaatattccaggttccacttgtaatttctctctccatccgtggaatcagttgtttccttaaatagccctgcttcttttattggataatggtatcttgaaaccaagacttgggtgttggggtgtggctttttgctactagggtgttattgcacatataatgttccctcctcagccatggggcctacattccaaggtcttcagtagatgcctgaaaccacagatagtactgaacctgatgtaataagttggaacatgttcctgtttatgtttttttctccaacaaacttaatgccttttccatcttaattatgcatttatcatgcatggtgcccattacttttgcagtctgaggtgtgacagcaaaactggcatgaatttttttcctttttcacaatttcataggtagaagattcatattttactgtaaatcttgaaaacctcagcataagatttttcctttccttattaagttgagaacttacacattttcacttaaaggaagcacttaatggcttctctttcrcagatccaaattatcagcatcactactattgcattttggggctattattaagtgaaataagagtaacttgaatagaagcatagtgataacgcaacagcagatctgataactgagatggctcataagtgactcatgggcagagagtatactgggcaaaaggaggattcatgacctgagtgggatggagcaggatggtgtgagatttcatcatgctacttagagtgacatgcagtttaaaacttatgagttgcgtatttctggaattttgcacatattattcttgtactgccattgactgttggtaactgaagccacaaaaagtgaaactccagataagaggagaattctgtatatagatgatatgatttggccctgtgtccccacctaaatctcaccttgaattgtaataatccacatgtgtcatgggagggactgggtggaaggtaattgaatcatgggggtgggtttttcccgtgctgttctcttgatagtgaataagtcacatgagatcagatggttttgtaacggggacttcccctgaaatgccctcttgcctgccgccaagtaagatatccttttgctcttccttcatcttccgccatgattgtgaggcctccccagccatgtggaactgtgagtccattaaacctcttttctttataaattacccagtctcaggtatgtctttattagcagcatgggaacagactaatacaatgcatttgactactgcttaatgggacatttgttattgaacaacaaacaagtggaccttttaggtacatcattttgggagtagccatcagttattcaaagctaaaatctagttgaaatcatggttttaagaatccttattgtaactatgacaataaaagactgcatcatcttttaaaatcttcttgagattaacaatcaagtctcatgatcgattggttggtaacacagattctataaccatggatttttgagcttgtgttctttatccttttgatttgataagaatgctgaaactctgggaaggcatcaaagttaacattgccataacactagaaatatgtgaagaaatatagaagtaacgaagaaaataagtcaaatgtgttgttaatcttctagaacaagcttaagtctggctatagtaatatattttcaaaacattgtatttctgtatgttttgtctactaatgaaggtgttggaggcattcaaaggaatcattaaattcattctaaatcagtaagtctattctaaagtgtttaaagagatttaattaattaagtttataataagtgttaaaatatcaaagaaaaatgtattggaagttttactggcaaaaatttaataaatagagaattcaaaaatacagcaaagaatgagtgttttccatgcacaaaagctccctgatattaaaaagctgaggggtggatggatgggctttgaggtaggatctgggcagagcatcactgtatccactacaattgtcattttattttaccttccccttgtaaggtcaaataaaatgttagaatatatagattcatagactatcaactctgagagggaccttaaatatcacatactttattatggaacacttagcacagataaaaaaattcaaacactcactaagagtcacttcatcaaggtaccaaaacataggttaagctacttcactatgttttagatgctcacactgtatctttcttcacgacttcataataaagattaagcgttgtgttttggatagtccacgttgtgctgtaagtgtgctactaaattccataccagatactgcctctgagaagcttcagaagaagcaatgaattataaagaatgctaatgcgtagtaaccaggggttacaggtgggaacatcacaatcactacctaggacagctgaaattcctagaagcagggaattgaaccagggaccaaacaaggtccctatcagctctttagctctggactgaattgagaaagtattattgtttttaactggttcccatttggccttattaagagtttaattgtgcttttactctaaccttttatcctcttgacatttctttccttaattttataggtttttttgtctcccttcattataattttcttcttatattatactatatttccatctggaaaaagaagtctgtgtctgccactttgttagaaggaccagcagaaaaatattcttaagaatagaaattgcctttattagctgagttgatgaaagaattatatgaggcaattatttcccacatctctgagatcttggccatgaattttaacaataattgcttgcaagtgtattttcttttctattgtatttaacttgagaggaaagatacttctttacctctttgtttccccaataactggtataggtcctgacacatggtaaactctcaataaatgtttttaaatgaattaataattggtaacatgttataattgttcattcaaatatctacgtctttactagactgaatttaaagaatggaataaaatcttattaacctttgtactactactagttcctgcattaactgtttatgtagtaggtactcaatacattgcaatgaatgaaggaatgaaaaaagaaatgagatggactaggaggaactctgcatctttactttagggttgtggatgtaaaattatttttcttccattcctgtcattgatgtgggcaattccacagtattcttatgtactgcctgctgctaaaagagcctcttgatgaaataaatctagaatttagtaagaactcaaggtaatttttagaaatgcaattacttcttcacagggtgagagcactggctacctaaagtgaaaggaaatgattatggtaggcaaagaatactgaaaggagaaagctttgctactctcttaatgtttccctgggtcatccccaggtactatggaaagacattgagacagtctagcctagtgtgtaagtactaaaatcagaaagaaaagcatatgcaacagcatttctataggactaaagaggaaagcaagtgaaacaaggcaaatggacaaacgaaaagcttcaataattcatcaaagaaacaatcaaaaatagatttaagtgcttactgtgtcctaggaattgtgataggtactgtagatatagcaataactagcaaatgttttctctatgctaaagagtttcctaggttgtaggggagattgatattgaatgaataccctcatgaaaaatgatatgtttacagttgaaaaagtgatatgaaggaaaaaaaatctggttccatgttgcatataacaatggggctaccctaatctgaaaggtcagcaacaacattcctgaggaggcatcttataacactagagggacaaaaaaaggcattagtaatacagagagagaaggaaagctattctagatacaactgagagttcatgaaaagaccccaagacagaacaagcttgaggtttcttagaaccaaaagattgttatggttggagcttagtgagaaagggaaagaatggagcaaattacagtgggagaggaaaacaaaagcatcagataaattatgtaatgcctgaaggccaaggagctagggtcttattttaataggaagatattgactaatttaatagaatttatggaggtatatcacccaatttatatttttataaataatgaatgtggaaaatggcaaactaggaagctccaggctctccaactccctcagaaataccaagtaaacaacaacatacccatcaaggtagctctgtgagaactctagaaaccattaaggatctgcaacaactaacaaatgcataaccaagaaaaatccacaggcaaaatagtagaaattttgtggtactttttcagatttaactcactgtttccctgatgcagcaaggaagagaagccaaccaatgactgattattctttcgggataaaaaataaaaagagtaacgcttatttgcaacattctggctcatatagggggctggccaagggacttgtttctatcttgcctgacttgaaatattgacagaaattatggcagagtttggatgtcaagttgggagttgctgaaaacagtttagtcatgatggcatgagagggcttcaggataactgcagacccattggtgcctggggcaagagattacaggaagaggaatacagtagaacatctaaggccctgagaaggagcagaggtgagactcttctgggaatcaagattttaaaagcaagggaattggataaaaagcacatgcactggcccaggaaagatgaattccaggaaaaggcctgaggaaaccttaagcttttacaccgggccagtttgtgaaggtcttcccctgcatggagccagtttccaaagactatctatggtggctattttattcaaatgccaaattttcaacagtgtattataaagcatataaagaaacagagaaacatggcctcttcaaattaacaaagcaaatataccaaaactgacctgaaagaaacaggcttcagacttacttgacaaagattcaaaagcacctgtcttaaatatgctcaatgagataaaagaagtacaagggcaacaaactaaaggaagtcaggaaaataatatatgaaacaatgaggattttaacagatataaattatgaaaaagaaccaaacataaattcttgaactgaaaaatacaataactgaatttaaaaattcactagagggcttcaacagcagacttgactggatagaaaaaagaatcagcaaacatgaagctaggtcatttgaaagtaagaagtctgaggacaaaaaaaagggaagtatgaagaaaagtgaacagagcctaagagacttacggaataacagtaagtggaccaatatacatattacatgagtcctagaaagggaagagagagagagaaaggggaagaaagtttatttgaagaaataatagctgaaaaaaatatcaaatttgaggaaaaacatggaaatacttttcaagaggctcaatacattctaggataaaccaaaagagacccacactaagacacattaaaatgaaactggaaggtgaaagacaaagaatcttgaaagcaataagagaaaagctatttttcatgtacacaggatcctaaataagattatcagaagatttctccccagaaatcttggaggcttcaaagtagtggagtgacatatttaaagtgctggaaaaaaaatcctgtccactgaaaatttgatagttggcaaaaatccttcaaaaatgaggaacaaattaagacatttccagataaacaaaagctgaaagagttaaatgtcattatgcctgcctacaagaaatgctaaagaaagttcttcaatttggaatggaaggacactagacagaaactcaaaaccataggaaaacatacagtttccaagtaaaggtgaacacgtgaacaaatttaaaaactattgttgtaattatgatcaataactccacttttttgttttataggacttaaaaaacaaaataaaaaattataaatctatgttaatgaatacacaatatataaaggtttactttgtaacatcaacaaacaacataaagtggggggtaggcagagcaataaaggagtaccattttttctgtatttggttaaagttgtcattattttaaaatagattgttacaactttaggacattatataatccccatggtaatcacatagaaaaatatctatagaatatacacaaaaggaaatgagaaggaaatgaagacatatcattacaaaaaaatcaaacacaaaaaaagcagtaagggaggaaaagagggataacaaagccacaagatatatagatagcaaataacaaaatggtaatagtaaaaactttcatatcagtaattactttcaagtcatgtaaatagattacattccccagtcaagagacatagattggtagatgggcaggatggaaaaagaaatcaaactacccaactatatactgtgtacaagagcatatagttggaagtgaaagatttaaaaaaaacatatttcaagcaaacagtggccagaagagagcagaggtggctatactaatatcatacaaaatagactttaaataaaaaactattacaagagacaaagaaggacattgtagaatgataaaagggttaattcaccaagaagatataataatcataaacatttatgaatcaaacattagagctcctaaatacagaaataaaaagtggacagaattgaagggagaaattgacagtgctacaattttagtaataaacttcagtacccgacctttaataatgaatagaaaaatcaggcagatcaataaggaaatagagaacttgaacagcactatagacaaattggagccaatagatacagaacactacacccaacagcagcagaatacatattttctcaagtatgcatggaacattctctagaataaatcacatgttaaaatacaaaacaaggcttaataaattttaaaagattaaaatcacagaaagtatcttttttattacartggaatgaaactagaaatcaacagcagaaggaaaactggaaattctacaaatatgtgagttagacaacacgatattcaacaatgaatgggtcaaagtgaaatcacataggaaattgtaaaatatcttgaggcaaatgaaaataaaaacaccatgtgttgaaatgtgtggaatgtaagaaaaacagtgttaagacagaagtttacagttataaatgcttacattaaaaaatgcaaataaataacctgaatgtatacatatgtaactaacctgcacgttgtgcacatgtatcctaaaacttaaggtataattaaaaaaaagaaaaataaataaatattaaaattcaaaaaaaaaaaaaaagagaaaaaggaaaatagagagggaaaaagctaagatggctgactagatgcagccaggaaacatctatcccacaaagagaactcaaaatattgagtaaatcatcagacttcatacagatcttttgagagaaaacacttaaaatcaataaacacagagacactgaggttgaagagggaggaagctgggaagcctgcacagagtcatcgagtagcaggactggcttctggtcctgaacaggtcgcaaggaaggggtgagtgaaggaactttggggcaccacacccctgccatggacctctgggatcctagctacaagagagcccgtgaccccaacggacatttgaattggcagggggaagtgcctgaagagtaggcagaggtagagctcaaacctgcatggagcccagaaggttttgcagtgcacagggcagctacagcaaaatgcaaccataagttcccatccctcaagactctccgtctttccctgagtaagtgtagcccttgctgactgtcaggctgggagagaggagggctacctttctcatgggaccagggcacatctgatccacatgccgtcttttctgctggcctcatgctccttcaaaagggtacgtacagcacagcctctactaacccacctgagtgttttggcagcttcctgggagcagttcatatccccagcactgctggtgcttgaccccagggagcctgaagacaaaattgcaggatggtcccaaccccccagagttcaatcataccacccaagggtattgagctgaaatctgtggccagagctcaagcaggaaggagccccactctcaaaacacagagaagaatgaggcatgggttcctgtgtcagtgtgagtgctagatgttcctccctctgcaaaactggtctggrcaaggtgtagtctgttggccagccacagcttctgtttgagggagccctggaagagcccagtgatctgggcacagaaggttttggacgagtttagctgttcaggcctgctcctgtggcagacactggagggagacctggtagggagatggtgagctgggtggactccacagccatttgctgggctaaaagatcccagggcaagggcatcacaccaactgcacacctgtggcaccacagccctaccaagggatcctccacccttgacccactgcatcacgagaccaccaccagacatatcccacaacctggtgtgactctcccaaactcagaggactagcaggttcacagagagttgcaactgtccttgtgacctaatctttggcattggccacccctaatggagggccgagtgcagcctacaagggccccttttgggctaaggagatgtagatatggtgccagtgattgaagggggtttctccaaggtctgggaacagccttggtgagagggtcatctcttgccccatctccccctccccagagcactgctgcataatcgctgaaatacaaaagtggtccacagctcagtaagagcctatttgctggcccatattcttaagtgctatctactgtatcaaagcttgaattataccaccaaacaaaaataaatttcttcagcatagaaagcctgtgaaactcaaagcaggaaactagccacaactaaggaacccacacagaactttggccctctgaaagcacccagaaaagaagccaatagattatgcactagaagtaccacagtcargccggatgcagtggctcatgcctgtaatcccagcactttgggaggctgaggcaggcggatcatgaggtcaggagatcaagaccatcctggctaacatggtgaaaccccatctctactaagaatacaaaaaaattagccaggtgtggtggcaggtgcctgtagtccctgctactagggaggctgaggtaggagaatggcatgaatccaggaggtggagctttcagtgagccaagatcacgccaccacactccagcctgggcaacagagcgagacttctctctaaaaaaaaaaaaaacaaaaaaaaccacagtcaaatcctcaagggaaaaaatatagaaacaaaaagccccattcgcacaacagaaactacaaaaagaaaagtaaacaacagacccccagataaaatgtaatcagggaaagaactccagcaattcagagagtcagagtgttttcttacttctgaaggattgcaatagctccccagcaatggatcttaaccggattgaaatgtctgaaatgttagacatagaattcaaaatctggatggaaggaagctcaatgatattcaagagaaagttgaaatccaattcaagaaagccagtaaatgatccaaaaagatgacatggtcattttaagaaaggacaaaaatgaacttctggaattaaaaaattcactacagaaatttcaaaatgcaatttgaagcattaacaacagactagagcaaggtgaagaaagaatttcagagcttgaagaccaatcctttgaatcaaccaagtcagacaaaaataaataaagaaagaattaaaaaaaatgcagtctttaagaaatatgggataatgtaaagagactaaacctgtgagtcactagcattcctaattgagaaagagaataagcaatgtgaaaaatatatttgagaatacagtcaacgaaaatttcccaatctctctagagaggttgatatgcaaatctgagaaatacagagaaactgcaataggtattatacaagatgaccatctccaaggcacagtcatcattcttttcaaagtcattgttttttttctaagaaatccaagaaacacagagaaactgcattagatattttacaagatgaccatctccaaggatcataatcatgattctttccaaagtcaacacaaaagaataagcttaaaggcagctagaaattatggacaaatcacttacaaaagaaacccatctagctaagagaagccttctcggcagaaaacttacaaaccaggagagggtgggggcctatttttagtgttcttaatgtaaaagaaattccaacctagaattttgtaaatcactaaacaaagcttcataagcaaagaagaaatcaaatattttccagacaatcaattgctaaaggaatttgttaccactagaccagccttacaagatatctgtaagggagttctaaacatggaaacaaaagaacagtatctgctaccaaaaaaacacacctaagtacatagctcatagaacctgtcaagcaactacataattgagagtacaaagaaaacagctaccaacaccatgacaaaatcaaaacctcacatatcaatattaagcttgaatgtaaaacaactcagccatctgctgtcttcaagagactcttctcacatataatgacaccaaaaggctcaaaggaaaggaatggaggaagatctatcatgcaaatggaagacatagaagagcaggcatagctgctgtcatatcagataaaacagactttaaacgaacaatggtagaaaggacaaagaagagcattgcataatgttaaagggttcaattaaacaggaagacttaactatgctaaatataggtgcacccaacatgggagaaccaagattcattaaaaagtacttctagtcttatgaaaagacttagacagtcacacagaaatattgggggacttcaacactctgctggcagcattagaaagattgttgaggcagaaaattaacaaagatattctggatttaaacttgacacttgaccaattagcctaatagatacctacagaatactccacctaacagccacaaaatgtatattcttctaatctgcacagggaacatactacaagattaatcacatgccttgaccatgaagaaagtcttaataaattaaaaaagatgaaattataccaaccatagtcttgggccacagtagaataaaaatagaaatgaataccaagaagatacctcaaaaccaacattacatgtaaactaaacaacttgctctgaaatgacttctgggtaaacaacacaattaaggcagaaattaaaaaattctttgaaataaatgaaaatagagacatgccataccaaaacctctgggatgcagtaaaagcagtggtaagaggaaagtttataatgctaaacacttacatcaagaaattggaaagatctcacatgaacaatctaacatcacacctacagaaactagaaaaataagaacaatctacctcaaagatagcagaataaaagaataacaaaaatgagagcacaactgaatgaaattgacaccccaaaatccatacaattaacaaaccaaaaatgaattatttgacaggataaacaagaatgatagcctgctagccatattagcaaagataaaaggagatctaaataaacacaatcataaatgacaaagatgatgttacaactggtctctcagaaatacaaaagattatcagagactattatgaacagatctacggaaacaaactagaatatttagaggaaatggaaacattcctggaaaaatacaaccttccaagtttgaatcaggaaaaaattgaaacccagaataatgaattctgaaattgaatcagtaataaagaatctactaataaaaaagagccctgaccagatggattcacaaccaaattctaccagaagcacaaagaagagctggtaattctactgaaactattccaaaaaaaatcaaggaggagggattcttccctaactcattttacaaagtcagcattactctgataccaaaacctggagaagacacaatgaaaaaagaaaactataggccaatatcccagatgaaaatatatgctaaaatccttaaaaaattactagcaaactgaatccagctgtacatcaaagagataattcaccacagccaagtagactttattccttgtatgcaaggatagttgaacacacataaagaatacatgtcattcaccacataaacagaattaaaaacaaaaacatatgatcattttaatagatgcagaaaacgtttttgattaagtccaatacacctttattataaaaaccctcaagaaactaggcattgaagaaacatacctcaagataatgacatctctgataaacccagagtgaacatcatactgattgggcaaaagctggaagcattcttcctgagaaatggaacaagacaaggatgccctctctcactattccttttcagtataaaactggaaatcttttctggaatattcaggtaagagaaagaaataaaaggcatccaagtaggtaaagaaaaagtcaaactatctcccttcactgatgacatgattctatacctagaaaaccctaaagtctttgccaaaaaacttctagaactgataaaagagtttaagtaaagtttcagtatacagaatcaatgtacaaaaatcagtaacatttttatatatatcaacagtgttcaagctgagagacaaatgaagaatgcaatctcatttacaatagctataaaaataaaataaaataaaaaataaaataaaataaaataaaataaaatacatctgaccaaagcggtgagagatcggtacaaagataattaaaaaaacactaccaaaagaaatcagaaatgacacaartggaaaaacattccacattcaaggactggaagaatcagtattgttaaaatggacatagtgctcaaagcaatgtacagatacaatgctatcattggtagtttcctatcaaactaccaatgtcatttttcatagaattagaaaaagctattataaaatttgtctggaaaaaagagtccatatagccaaagcaatcctaagcaaaacaacaacaaaaataaacaaagctagaggcatcatattacctaattttaaactatactacaatgttactgtaagcataacaacatggtacttgtacaaaattgtacatatagaccaacggaacaaaatcaagaacctagaaataaagccgcacacctacaaccaactgatcttcaacaaagtcaacagaaataagcagtgggaaacaggctccctattcaataaatggtgctgtgataactggctagttatctggaccccaatttatcaccatatataaaaattaacccaaggtggattaaacacttagacctcaaagtataaaaattctagaagaaaacctaggatatatccttctggacgttggccttggcaaagaatttatgcctaagtcctcaaaagcaattttataaaaataaaaataaaaatcaataagtgagacctaattaaactaaagagcttctgcacagcaaaagaagctatcaatggaataaaaagataacctaaagaatgagagaaaatattcacaaactatgcatctgacaaagatctaatatccagaatttataaagaactaaaataattcaacaagtagaaacaaataatcccattttaaaaattgggcaaaagacataaagaaacacatctcagaagaagacatgcaaatatccaacagatatatcaaaaaatgctccacatcactaatcataagagaaatgaaatcaaaaccacagtgagataccgtattcatctgttctcatgttgctaataaagacataaccaagactgagtaatttataaaggaaaaaggtttagttgacccacagttcagcatggtttgggaggtctaaggaaacttagaatcatggccgaaggggaagcaaacatgtccttctttacatggcagcagcaagaattgctgagcaaaagggggaaataaaaccatcagatctcgtgagaactcactatcatgagaacagcatgaaggtaaccaccttcatgattaaattacctcccaccaggtgcctcccatgacatgtgggggttatgggaactataattcaagatgagatttgggtggggaagccaccaaacctcatcaaacagtatctcacaccagtcagaatagctattattgaaaagtccaaaacaataaatactggtgaagctgcagagaaaagagaacccttatgcacaattggtgggaatgtaaattagttcaaccattgttgggagcagtttggacttttctcaaagaactaaaatagagctaccattagacccagcaatcccattactgagtatataccaaaagagaaataaatggttctacccaaaagatagatgcactcatatgttcattgcagcactattcacaatagcaaagatatggaatcaacctaggtgcccatcaacaggattggataaataatatatggtacatatacaccatggactactgtacatccataagaaagaatgaaatcttgtcctttgtgttattatggatgcagctgggggccattatgctaagtgaattaacacagaaacaaaccaaatactgtacgttctcacttataagcaggagctaagcattgggtacttatggacataaagatgggaataatagacactagaggagggagaaaggtagaagggcaaaggctgaaaaactatctgttgtatactatgcttactatctgtgtgacaggatcaatcatacaccaaacctgagcatcatgcaatatacctatgtagcaaacctgtatgtgtacccccaaatctaaaataaaagtaaaaacaaaggaaaatagaaaaagataaacaacacagattagaagaaaatagaaaaagcatacagaaaattaatgaaatcaagagttgtttcttccaaaaggtcaacaaaattgacaaacaaaactttagctagattgactaaggaaaaaggagatactattcagatagctaaaattagaaatgaaagcaggaaccttccaaccaattttatggaaatgaaaatgattgtaagtattatgaaaaaggataacctagataaaatggatatattcctagaaaaaacaattcatcaagtctgagtcttgaagcaataaaatctcaacggtgtataactattaaggagactgaattagcaacttaaaacctccccacaaagaaaaattcaggtgcatatggcttgactgctgaattctcacaaacactaaaaaaaaaactaacatctgtctccctcaaactcttccaagaaacatataagtaggaaacactttcaaacttattctatgagaccaacattaccctgaggtcaaagccagaaaaaaacattgcaagaccaatatccctgatgaatattgatccaaaaatcctcaacaaaataatagcaaaccaaattcaacagtacattaaaaggtttcaacacctatgttcaaaatatgaatattgatcaatgtaatataccatattaacagaatgaagaaaaaactcacataattctctcaattgatgagaagaaacatttgacaaaattaacacacttttcatgataataacatgcaacaaactaggaataagaggaaactacctcaacctaataaagaccatatatgaaaagcccataactaatattatactcactgttgaaagattgggggggtgaagccaagatggccaaataggaactgctccagtctacagctcccagtgtgagcgatgcagaagacaggtgatttctgcatttccaattgaggtactgggttcatctcactggggagtgtaggaaagtgggtgcaggacagtgggtgcagtgcaccgtgcatgagctgaagcagggtaaggcatcacctcwcccaggaagtgcaaggggtcagggaattccctttcctagtcaaagaaaggggtgacagacggcacctggaaaatcaggtcactcccaccctaatactgtgcttttccaatgggcttaacaaatggcacaccaggagattatatcctgcacatgactcggagggtcctatgcccacagagcctcgctcattgctagcacagcagtctgagatcaaactgcaaggtggcagtgaggctgggggagcggtgcccaccattgcctaggcttgagtaggtaaacagagtggcctggaagctcaaactgggtggagcccaccacagcttgaggaggtctgcctgcctctgtaggctccacctctgggggcagggcacagaaaaacaaaagacagcaataacctctgcagacttaaatgtccctatctgacagctttgaagagagtagtggttctcccagcatgcagcttgagatctgagaacaggcagactgcctcctcaagtgcatccctgacccccgagtagcctaactgggaggcaccgcccagtaggggtggactgacacctcacatggccgggtactcctctgagacaaaacttccagaggaacgatcaggcagcagcatttgtggttcaccaatatctgctgttctgcagccaccgctgctgatacccaggaaaacagggtttggagtggacctccagtaaactccaacagacctgcagctgagggtcctgactgttagaaggaaaactaacaaacaggaaggaaatccacaccaaaaacctatccagccagagagaaaggtcgagttatctacaaagggaagcccatcagactgacagcagatctctcggcagaaatctagaagccagaagagagtgggggccaatattcaacattcttaaagaaaagaattttcaacccagaatttcatgtccagccaaattaagtttcataagtgaaggagaaataaaatcctttccagacaagcaaatgctgagagattttgtcaccaccaggcctgccctacaagagctcctgaaggaagcactaaacatggaaaggaactactggtaccagccactgcaaaaacatgacaaactgtaaagaccattgatgctaggaagaaactgcatcaactaacgagcaaaatagccagctaacatcataatgacaggatcaaattcacacataacaatattaaacttaaatgtaaatgggctaagtgtgccaattaaaagacacagactggcaaattgaataaagagtcaagacccatcagtgtgctgtactcaggagactcgtctcacgtgcagagacacacataggctcaaaataaagggatggaggaagatctaccaagcaaatggaaaacaaaaaaaaggcaggggttgcaattctagtctctgataaaacagactttaaaccaatacagatcaaaagagacaaagaaggccattacataatggtaaagggatcaattcaacaagaagagctaactatcttaaatatgcacccaatacaggagcacccagattcataaagcaagtccttagagacctacaaagagacttagactcccacacaataataatgggagactttaacaccccactgtcaacattagacagatcaatgagacagaaagttaacaaggatatccaggatttgaactcagctctgcaccaaacagacctaatagatatctacagaactctccaccccaaatcaacagaatatacattcttttcagcaccgcaccacacctattccaaaattgaccacatagttggaagtaaagcactcctcagcaaatgtaaaagaacagaaattataacaaactgtctctctgaycacagtgcaatgaaactagaactcaggagtaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtggagagggaaatttatagcactaaatgcccacaagagaaagcaggaaagatccaaaattgacaccctaacatcacaattaaaagaactagagaagcaagagcaaacacattcagaagctagcagaaggcaagaaataactaagatcagagcagaactgaaggaaatagggacacaaaatcccttcaaaaaatcaatgaatccaggagctggttttttgaaaagatcaacaaaatggatagactgctagcaagactaataaagaagaaaagatagaagaatcaaacagacgcagtaaaaaatgacaaagggtatatcaccaccgaacccacagaaatgcaacgtaccatcagagaatactattaacacctctatgcaaataaactggaaaatctagaagaaatggatcaattcctcaacacatacaccctcccaagactaaaccaggaagaagttgaatctctgaatagaccaataacaggctctgaaattgaggcaataattaatagcttaccaactaaaaaaagtccaggaccagatggattcacagccgaattctaccagaggtacaaggaggagctggtgccattccttctgaaactattccaatcaatagaaaaagaggaaatcccccctaactcattttatgaggccagcatcatcctgataccaaagcctggcagagacacaaccaaaaaagagaattttagaccaatattcttgatgaacattgatgcaaaaatcctcaataaaatactggcaaaccgaatacagcaacacataaaaagcttatccaccatgatcaagtgggcttcatccctgggatgcaaggctggttcaacatacgaaaatcaataaatgtaatccagcatacaaacagaaccaaagacaaaaaccacatgattatctcaatagatgcagaaaagtcctttgacaaaattcaacaacacttcatgctaaaaactctcgataaattagttattgatgggaygtatctcaaaataataagagctatctatgacaaacccacagccaatatcatactgaatggacaaaaactggaaacattccctttgaaaactggcacaagacagggatgccctctctcaccactcctattcagcatagtgttggaagttctggccagggcaatcaggcaggagaaggaaataaagggcattcaatgaggaaaagaggaagtcaaattgtccctgtttgcagatgacatgattgtatatctagaaaaccccattgtctcagcccaaaatctccttaagctgatatgcaacttcagcaaagtctcaggatacaaaatcaatgtgcaaaaatcacaagcattcttatacaccaataacagacaaacagagagccaaatcatgaatgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagagtcaatatcatgaaaatggccatactgcccaaggtagtttatagattcaatgcgatccccatcaagctaccaatgactttcttcacgaattggaaaaaaactactttaaagttcatatggaacctaaaaagagcccgcattgccaactcaatcctaagccaaaagaacaaagctggaggcatcacactacctgacttcaaactatactacaaggctacagtatccaaaacagcatggtactggtaccaaaacagagatatagaccaatggaacagaacagaaccctcagaaataatgccgtacatctacaatcatctgatctttgacaaacctgagaaaaacaagcaatggggaaaggattccctatttaataaatggtgctgggaaaactggctagccataygtagaaagctgaaactggatcccttccttacaccttacacaaaaattaattcaagatggattaaagacttacatgttagacctaaaaccataaaaaccgtagaagaaaacctaggcattaccattcaggacataggcatgggcaagcacttcttgtctaaaacaccaaaagcaatggcaacaaaagccaaaattgcaaatgggatctaattaaagtaaagagcttctgcacagcaaaagaaaccaccatcagagtgaacagacaacctacagaatgggagaaaatttttgccacctactcatctgacaaagggctaatatccagaatctacaatgaactcaaacaaatttacaagaaacaaacaaacaaccccattcaaaaaggatatgaacagacacttctcaaaagaagacatttatgcagccaaaaaacacatgaaaaaatgctcatcatcactggccatcagagaaatgcaaatcaaagccacaatgtgataccatctcacaccagtagaatggcgatcattaaaaagtcaggaaacaacaggtgctggagacgatgtggagaaataggaacacttttacactgttggtgggactgtaaactagttcaagcattgtggaagacagtgtggcgattcctcagggatctagaactagaaatgccatttgacccagccatcccattactgggcatatacccaaaggattgtgaatcatgctgctataaagacacatgcacatgtatctttattttggcactattcacagttacaaagacttggaaccagcccaaatgtccagcaatgatagactggattaagaaaatgtggcacacatataccatggaatactttgcagccacaaaaatcgatgagttcatgtcctttgtagggacatggatgaagctggaagccatcattctcagcaaattatcgcaaggacaaaaaaccaaacaccacatgttctcactcatagatggaaattgaacaatgagaacacatggacacaggaaggggaacatcacacaccagggactgtagtggggttgggggaggggggagggatagcattgggagatatacctaatgttaaatgaggagatgatgggtacagcacaccaacatggcacatgtatacatatgtaacaaacctgcacattgtgcacatgtaccctaaaacttaaagtataatactaataaaaaaagaaagattgtaatcttttcctttaagattatgaacaagataaaatggtgagaggtgcccctgtcaccatttctattcaccacagtacttgaagtcctaatcagagcattagacaagaaaatgatataaaagacattcagttgttctctgtctttgcagattacatgatcatatatgtggaaaaccctgaagattaacatacatacacagaaacctcttagaactattaaatgaattcagcaaagttgcaggatacaaaatcagcacaccaaaattattttgttttttatacactggcaatgaacaactttgaaaggaaattaagaaaacaaattccatttaaaatagcattgggaataataaaatacatattaattaacttagccatggagatgaaaggcttatacctgaaaattacaaaatattgctgaaaacaaataaatgggaaatcatcctatgtttgtggattggaagacatattactgttaagatgttgatactacctagggtagtctacagattcagtgcaatccatatcaaaaccccaaaacatttttgcaggaatagagacaacctgttgagttagagaaaatatttgcaaactactcatccaacaagggactaatatccagactatacaaggactcaaacaactcaacacttaaaaaaacacaaagaatcccattaaaaagttggcaaaggacatgaacagacatttctcaaaagaaaacatacaaatgaccaacaggtatacaaagcagtggtcatcatgactaagcatcagggaagtgtaaaccaataccacagtgagataccatcttaccctagttagaatggctattactaaaaagacaagcaacagatgctgggaatgatgcagagaaaaggaaactcttacacactgttggtttgaatgtaaattagcacagccattatgaaaaactgtatggagatttttttcaaaaatctaaaaatggaattaccatatgatccaacaakcccactaccaaatatttatccaaaggaaaagaaatcagtatgtcaaagacatacctgcacttggacgtttattgcagcactattcataacagcaaaggtatggggtcaacctaaatgtccatcattgaatggatggataaagaaaatttggtatgtacacacacacacacacacacacacacacacacacacacatacacagtggaatactatctagccacagaaaagaatgaaattatgtcatttgcagcaacatggatgaattaataaagtgaaaagacaaaaaaggaaagaaaaacctatcctaaaatttatatggaatcttataggatctgaataatcaaaataatcttgaaaaggaagaagaaagtatgagttatcccactttctgctatcaaaacttatttacaaagctctagtattcaaaacagagtggcataaagatagataaataaaccaagagggtagaagagagggaccagaaataatctctcatatatgttatcaagggtgccaagagcattcaatccggtaaacgacagtgtttttcaacaaatggtcgtagtggtgggggtactggatatccacgtacaaaagaataaaatttgattcttgccttataccatatgcaaaaattaaataaaaatggatccaagttctaaatgtaagacctagaactaaaaatcttttaaaagaaaacaggagaaaagcattatgacattggatttggcaatgatttcttgaataggacacccaaagcacagacaacaaaagaaaaaaaatagataaaaaaactacatcaaaattaaaaactgtgcatcaaaggaacattcaacagggtgcaaaggtgcaaaagcaacacacagaatgggtgaaaatatttgcaaatcacatatccgattggggttaatatccagaatatataaaataagtcctataactcaacagcaaaaaacaacccaattcaaaaatgggcaaaatacttgaatagatatttctttaaagaagatattcatgtccagcaagcacatgaaaagatgttcaacatgactaacattagggaaatgcaaatcaaaaccgcaatgagacagcacctcacactcattaggttggctgctattcaaaacaaacaagcaaaacaaacaaaactgagcagaaaataaaaagtgttggctagcatgtggagaaattagaacccttgttcactgttggtgggagtgtaaaatggtacagctgctatggaaaacagtatggtggttcctcaaaaaatgagaaaatgattactatgtgattcagcaagtccacttctgggtatataccccaaagaattgaaagtagggtctcgaggagatagttgaacacctatgttcatattaacattattgrcaatagctaaaaggtgaaagcaacctaaatgtccattgatggatgaatggataaacaaaatgtggcatatgcctatgatggaatattattcagccttagaaaggaaggaaattctgacacatgctacaaatatgggtgaaccttaaggacagtatgccaggtgaaattggccagtcagaaacagaaatactgtatgactctacttatatgaggtacccagagtactgaaatatagagacagaaagtagaatggtggtttccaggggctggagggaaggggaatgggcagttagtgtttaatgagtacagagtttcagttttgcaagatgatgagttctgaagatggatggtagtgctggttgcacaatattaatgtactcagtaccacttaactgtacacttaaaaataattaaggtggtgatatggtttgactgtgtccccacccaaagctcatcttaaactgtagctcccataattcccacgtgtcataggagggacctggtggaaggtaattgaatcatggggttgggtcttttccatgctgttctcatgattgtgaataagtctcatgaaatctaatggttttataaaagggagttcccctgcacacactctcttgcctgctgccatgtaagacatgacttgactcctcctttggtttccggcatgattgtgaggccttctcagccatgtggaactatgaatccactaaacctctttttctttataaattacccagtcttgggtatgcctttattagcagcgtgaaaatggaataatacaggtggtaaatttcatgttatgtgcattttaccacaattaaaaataataaaaagatgatcatgggcttctagttcaattattccatttcttctccaaattataatcttaccaaaggaaaaaaaaacaaatgagatttaaactgccaagaacaagggcaaggtgagggtctttgggccttataattgatgaatatcttgccaaagtaacattacttagagtttcaaattgctgaacgatgaccaataaatttgagaggaggagggggatgaaagagcacagtgtcagggagctagttcttctatgttttatggaaggatgttaatagattttccttcaaattaataaaattaggacaagtagtatatattttaattgagataactgtagaagaactaaaacgtatttgatcaaaagtgataatttcagcaagctaacctgggatagtagaaatagattaggaaggcctaaattttcatattgtactctttattatcatttaaagcattttttatgcacatacattgctttagttttaataattctaaaattctcacataatatagcagagtataatgagaaatataataaacaccttttttcttaatagctagatttttcaaatcataacattttaccatctgtgcttcagatatttgctaagaaacaatatattacagatacatttgaagtttctacctaataattcctctccttccccaggggaggttggtgttttttatattatatttatgatacacacacattttaaatcaatatatgtatcatatataatacaaatggtaaagcactaaatattttttccatattttaaaatttatgtaaatagcattatactttctatattctgcaattttcttttattgctcagtgttctgtttgagaggagtggttttgaggccttgaagtaaaaattatgatttattgcttttgttatttatttatggggataaataattatgtgataatataatccataagtattactgctatgtaacttgtatagataacattttataatcaaagacatttacaaactttgtatcaaaatgataattggagtcctgtttagagaacaaactaaaaaactttggcagaaaggagaagcctgttttttgagaaatgattttgtttttgctttaaattggataagtttttctggaccatagctaatgtcaattttcataataatatactggttgcataatccatttgccagtttgtcttggctgaagaagttactgaaggtgaataaaattgtaagtttttctctccttgggaacagtttctgagttattgagagaaaaggagcccaagtaccttagtgaatgggtcccggtgaccccacacaaagttgtaggagctgagctttcattagaaatagtgtttgtcccagaatattctatgcgccattttatttagtttcttctacagtcctcagaaatagacattattttctcattattcaaatgaggtaattagagcacagaggtttgcaaatcacccaaggtcacccaggtacatggtagaattgggacttaaagccagttcttttttcctccagtgttctttctattcctgccaatgcagataaacctttgaaaaaatgtaaaagtctgacttgggaaaaggaatttagtttattttactttccaatttctcagtctgattttcacaaagagagttttttgttgttgcttgtgaataggtttctatatatttttattggccctagctatgtgactcttctcaaagcctaaaaacctgaatgtattttcaaactgataatggtcacttctacccaacattatgagctttgtcaatacgttttcctcatcttctgtcatacatatgcatgcttattttattttttacatatttatttcttattttctccccccaaattcacctccctcattgtccaaattcaatacagctatggtattggcaatatctactttgccttcttatgatgtggtcatttgtatcaaatgagaaaacaaatgttgtttcaaagtatgatgagctatacaaatgaaagagatctagaaactgtatttcagtctgaagtttaatgttactctctcttatgccaggataggattaccagtgatgtcagtgaacagaaaaagagatacattttcccacagttttgttctttgaaaaactatgttttgttctctgtaaataaaggggaaagaatgattttatagataatgctttcatttgcatgtaagacagcaaaattcaacggaccaattacaatcatgcatttttattttggcaaacttttttcttgccatttaaaattcgtaaattttattgtatataacccagtaaagttgattttagaaatctctaaaagttaaaaaaaaacccaaagaatgtcactatttgcaaccacttaagatctaagtattaagcatctgtggctgctaacatcacaaaaagagagacaactagacactatgtgccttttgctgaaagatcgtaccactacctagggtcatacccaaaacagatacttgcctctgatcaatcatctggatccaacaacgaatttacaagttacatagcagccagaagatacatggaactactctatgggaattcaatcagccaaacccatatcgtgagaacatttatagaaaaacaaccttcatcaagtaaattttaaggataaaatagaagagatagagggcaagatagaagagatagagggaaaacttgcacattcaaagagatttaggtatctatcacattgaagagattataattcctcatcttgttgatgttcatgccttttgctgtctaatgttacagtacccctccaccataggaggggttacctgttctaccccttgacactgggctcagacactctcagcatttcctattattaacatcttatattagtatatggtagatttttgtgattagccaaatatttatatattattattaactaaagttcataattcactcagatttccttagtttttacctaatgtcccccctttttttgtcccagaattccatccaggaaaccacgttacatgtattcatcattttcttggactcttcttggctgtggcactttctcagactttccttgtttttgataaccttgatagttttgaggagtactggtcaggtattttgtagaacgtttcttaattgggatttgtttgacatttttctcattaaagtcagtataaggatttttgggaagaaggcctcatactatcaacatgacatcactgttgatgttgatcttgctcccctgactgaggtgatgtgggtcaggtttctccactcataagttactccccctctgcttttcctactgtactctttagaaagaaatcactatgcaaggctaacatttaaggagtagggagttatgctccctctgcttgaaggcagaatgtctatataaattctgcatgggagatttgtctgtttttccccattaatttattcaatcattgatttatattagtatggactcatagatatactttggattataattcaacactgatttattttgttgttcaaactcttccatctgatgatagtttattttgctgtgcagaagctctttagtttaattagatcccatttgtcagtttttgcttctgttgcgtttgcttttggcattttcatcatgaaatctttgcccatgcttatgtcctgaatgttattacttagattttcttctagagttttacatttaaattttgagttttacgttgaaggctttaatccaccttgagctgatttttataaatggtttaaggaagggatacagtttcaattttctgcatatggctactcatttctcccagtaccaattattaaatagggaattctttccccattgcttatttttgtcaggggttgtcaagatcagatggttgtaggtgtgtggtcttatttctgagttctctattctgatccattggtctatttgtctattcttgtaccagtaccatgctgttttggttactgtagctttgtagtatagcttgaagttgggtattgatgggtattgaagctgggtatgatgcctccagctttgttcttttgcttaggattgtcttggctattcgggctcttttttggttctgtatgaattttaaaatagttttcttctaattctgtgaagaatgccaatggtagtttcatggaaatagcattgaatgtataaattactttgggcagtatggctgttttcacaatatttgttctttctatccatgagcatggaatgtgttttccattcatttgtgtcctctctgatttctttaagcagtggcatgtagttctccttgaagaggtcctttgcttccctggttagctgtattcctaggtaaacacaatttgaattgataagagggatatcacactgactccacagaaatacaaactaccatcagagaatactataagtacctctatgtatataaactagaaaatctagaagaaatggatgaattcctggacacattcaccctcccaagactgaacaaggaagaaattgaattgctgaatagaccaataacaagttctaaaattgaggcagcactacctagtctaccaaccaataaaagcccaggatcagatggattcacagctgaattctattagaggtacaaagaagatgaggtaccatttctactgaaactattccaaaaaattgaaaggaagggaaccctccataactcattccatgaggccagcatcattctaataccaaacctggcagagatacaacaataacagcaacaacaacaaaaccttcaagccaatatccttgatgaacattgatgcaaatatcctcaattaaaaattggcaaaccaaatccagcagcatatcaaaaagttgttcatcacagtcaagttggcttcacccctgggatgcaaggttggttcaacatatgcaaatcaataaatgttattcatcacacaaacagaactaaaggcaaaaaccacatgtttttctcaatagatgcagaaaaggcctttgataaaacttaacatccctttatgttaaaaactctcaataaactaggtgttgaggaaacatacttcaaaatagtaacagccatatatgacaaacccacagccaatatcataccgaataagcaaaagctggaagcattttccttggaaactggcacaagacaaggatgccctctctcaccatttctattcaacatggtattggaagttctggccaggacaagcaggcaagagaaagaaataaagggtattcaaataggaactgtctctgtttgcagatgacataatcctatatctagaaaatcccattgtttcagccccaaagcttctaaagctgattagcaacttcagcaaagtcacagaacacaatgtcaatgtgcaaaaatcactagcattcctatacaccaacaataggcaagcagagagccaaatcctaaaagaacttcctttcacaattgctacaaaatcaataaacttaccaatttttttctctcatagattttgcttttggtgttgtgttaaaaacttatcaaactcaaggtcttgtagattttctcctgtttccttatagaaatttcacagttttacactttacacttaggtctacactctagataatttttgtaaaaggtataagacttgtatctggattaattttttcacatatggacattattttttcagcattattttataaaaaaaacttttctttctctattgaatttttttgacataactcagttgactttatttgtgtgtgtctttttctggggtctccgttctattcaattcatctatatatctattcttttgccaatacgatcctgccttgattatggtagctttgtagtaagtcctgaaattcagtagtatgtcatctaacttgttacatttctccagtattatgttggctattgtagacgttttgcccttccatatagacttcaggattagcttgctgatatctacaaaatagattcctaggaatttgattggattcccttggctctatagataaagttgggcaaaattgacatcttttttttttttttttttttttttttttgagacggagtctcgctctgtcacccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacagggtttcaccgttttagccgggatggtctcgatctcctgacctcgtgatccgcccgcctcggcctcccaaagtgctgggattacaggcgtgagccaccgcgcccggcccaaaattgacatcttgacagtattggatattccaatccatgaacataattttttttatcaatttatatattttttatattttcttttttcatcagagctttgtagttttctacttatacatattttgttagatttatccctgaatatttcttttcttttttttcctctctagttttggtgcagtggcaagtggtattgttttaaaatttcaaattccaattgttcattgatggtacgtaggaaagcaatttacttttaaatactgaccgtgtatcctggatccatttatttccaaatatatttagatttctctttagatttctttcatgactcatggcttattctaaagtatgctgtttaattctcaaatatctagggattttccagctatttttctgttattgatttctagcttaattccattgtggtctaaaaacatactttgtatgatttttattcttttacctatgttaatatgtgttttatggctcatgatgtagtctgtcttggtgaatgttctgagttttagaagattatgcattttgctgttattggatggaatattctataaatatcaattagatcaagttgattgataatgattgataattcagataatctatggtcttattgattttctctctacttttcctactaattactgaatagaagtgttgaagtctctaactataatggagtatttgtctaattatcctttcagttctttcagtttttgcctcacatgttttgatgctctgttgttaggtgaatatatcttcacaaagatattggagaactgactcctttatcattatgcagtgctcctttttactcctgcttattttatttgttttgaaatttgctttgtctgaccttaatatagctgccccagctttctattgatatatgtcagcattgtatattcttcttcatccctttacttttaatctgagtcttttaaaatttaaagtggactgcttatagacaacatagattgtatcttaatttcttatcaactctgaaaatctcttttatttggtgtatttagaccagtttgttacacttaaagtgatggttatttatatatttagacttacaggtaccgtgcttataaatgttttctatctgttgcatttattctttgtttcttctttcccctctttttctgccttctgtgtttttaactgggcattttatatgattccattttatcccttctcttagcatatcaattatacttttaaagagttcgagattgctctagagtttacaatatatgttttaactaatataagtctaacttcacataacagtatgccacttcatgtagactatagttgctttataatagaatattattccccattcttccctcctgcccatttcactgatctatatgctgaaattacttattatattgctatcattaaacagtcatctattagtccacttaagtataagaaaaataaaatattttgttttaccttaatttattctctcatttctctctctttccttgtagatccatgtttctgaaccacatgattctccttctgcctgaagaacttctttaaacttttcttactgtgtctgcaggtgatgaattacctcagtttttgtttgtcttataaagtgtttatttctctcctaattttgaagggtcattttgctagatatacaattctaagttggtggattctttttctttcaacactttaaatattcactccattcttttcattcaattcttttcttgcttgcatggtttctgagaagtccactgtaattcttatttttgttcctctacaggtaatatgttttttcctctggttacttttaaggttttctctgtttttggttttctgaagtttgaatatgataggtgcaggggtggttttttgaaggtgggggtgagggttgctatattagtccattttcacgctgctgataaagacatacctgagactgggcattttacaaaagaaagaggctcaaatggacttccagtttcacatggctggggaagcctcacaatcaagtgaaaggccaggaggagcaagtcacgtcttacatggatggcagcaggcaaagagagagcttatgcaggaaaactcccccttataataaccatcatatcttgtgagacttactatcatgagaacagcatgggaaagacctgcctccatgattcaattacctactaccaggtccctctcagagcatgtgggaattcaagatgaaatttgggtggggacacagccaaaccatatcagttacttatactatttggtgttctctgagctttctgggtctgtttcagtttctgtcattatttttggaaagttttcagccattattacatctaatatttcttctgcttcattttttccttcttctactgatgttacaccttttgaaattgtcccacagttcttggacgtcctgttttgttgggttcatttccctctttcttttttttctctttgcagttcagtttgagaagtttctattgccttatcatcaagctcactgattttttccttggctatgttcagcctactgatgacctcatcaagggaatcctttacttctattactatgtttttgatttctaacacctccttttgagtctttcttagagtttccacctatcttcttacattacgcatttttatatgttgtctatctttttctgttagagcccttaacatactaatcatagttattttaaattccccatctgataattccaacatctgtgtcacatctgagtctgactctgatgattggtttgtcttttcggactgtttttcttgtcttttggtattcctcatagcattgtattgaaagctagacattgtattgtatactaggggctgagataatatgtttttagtgagaaaatttatgttaatatgggtttaatatttgttgtagctatagctgccacagatttcagaaccattcagtgtccttgtttttgcctctatccttgagggattcctaaattctcttcttcagagaaagtcagtgtcttgtagctcttttgtatgtaatcaattattattatactggagctcgatggtttggtagtaaaaggtggggaggaatagcagtctatatataatgttaaaattacatctcagtgttttggtgaaggggaatggtctgtaccttttggctatgaccatcaacactgtcttcccagtggtacagctttttttttcttttctttctgctccctcctccctttcttggatgcagtcttcctagtccatttcgttgaagccctggctcctgttgattatttttttatctgaggtgagacaggaaagctagaagggcttggaatgggtggaatgaccgtccctcatgtaacataacctcaaaaaatgcctcttctcttaaatagtaggcctttattttaaagaaggctcaaagattacaattattcctctttccctctcccttcggaggcatgatgggatgattatctgttgggtttcctggagataaagctcctgaaaatttaggggtctgcctcagacctcagccatcaaggagtttctcatgctcatgttagttcacgctcagtctccagcaattcaccaaaataattacttaagtgttcctaccggatgatggctcaagaagcttaagtttcaggtaagcagatcttagctgtgcctctctgtaaatgcctgtctctctggatttgggggtattgatttatgctgaaacttcaatttccttatgggtccaagaaaagtcattgatttacaaatttttcttgctgtagacagaagtgataatatccaagccctttacatgcagctgaacctggaagtttctttgttttaaagttcttcatacaggtttcacacatgatttgctaagtttattcctatatacttactctccttgttgatattgcaaatgaggttttctctaccattataatctttaacaggtttgctcctttaaataaggttgctgatttcaccatattatttttatattctgcaacttcattgaattatttcatgggtaacgcttcttgtatcattgattctctaaagttttttaggcatactattaggtttgtgcaaaagtaaatgtggtttttactgttacttttaattggaaaaactgcaattacttttgcaccaaccaaatattattgcgagtagcaataattttactccttctttaccaattcttatacctttaattggtttctcttctttaattgcataggtaatacctctgatacaatggtgtatagtcataaggatggtggtcatccttgtcttgtttataatcttaatgaaaatggttctgatattttcccatttagtaagatattggcttaggatatctatctatctatcttatcatgctaagaaagaaattttaagtttcttttttttttagtgttttcaccaggaatcagtattgaatttcatcagaggatttttcattatctatggagatacataattttttttcttagatttaataatgtggattataataccaatrggttatctaatattggaccaactttgcattctgaaagaaattccacttagttgtgttgtattgatttcacaatgtataagattctgtttgctaatgttttagttggtatttttacatcaatatccataaacatactgctctgtaggtttttttttgtatttttaaaaatttagatttaggtattagtgtagtacttgcttcttaaaaattgggaactttttattcatctttaatgttctgcagcactctataaaacattggaaatatcaaatctttgatgattcggtagaatttttttccaaagttatctgggcaaggtgctttttkgttgatgtttttcttaataacttactttttatcttctatggaaaatgttgtctatctataactgagtcaaatatcatttattttattgccctaagaaattatccatttcctctgttttcaaacctatttgcatagaggtctgcaaaatagtcacgatattttaaatttttgtttcagtggttgtttccccttgtcatcttctatttttttattttataatttctcctctattttattaatttcttcaaacttacaggaatttgatttcaatggcaaaagatttatatcaaatcttaagagaaaccagagtataggaattcgattaataagtctactgtttttctatttttaattgattaatttctacttttatctaattttatgcttctttgtgctttctttttacttttttattgttttttgagctgggtttttaatttcttaatttcgttaaaaatttttaaatcagaaatatttagtttatttagttctgtgacttttcctctaaatactaatttcaatacatctttccattattatttttcagaaattttgtcatgtaagtttgtattttccctttaggtagaatgttttctaataaacattttttcttaaaatttgcgtggaagagtctttttgctctttaattctgttarcaatttctagtttttattgcattatgatatttattgttgtgatatttctactttttgaaacttactgatattttctttgtgacttaatatttgattatgttttgtaaatgttttattgcacttgagaagaggtgtattatttactgtatggctgtaagtttggtatatgcttataaagtttggtatatggttataaaatctaccctgttttacatgttgtctagatcttacaactctttagtattaagttgtgacttttagcattttcgttatatttaatttttttggattgaattctagtttggctgatagcagattacatttcctgatttcttattgtttccattgactttaatgttttgttcatctcttaattttagattttctgattcaccttgttttatgtatgttttttgtatgtagcatatagttacatcttgctctgtgtaccaaactgaaaatcctttccttttattaatagtttagcccatttttttacatttatatttagcccatttatatttatattgatatggttgcaatttttattttacactctgacacaatagtttatagttatgtatattttaagttatttgctatgtttctctttctccctctgcatgatgtgtcttttttgccttttaatatttttctaggtatgcttttgtttaccacaaaagtggccagcagggtaagaccatgagaaaacatgcatggggatttggtgtttattctttttgttacttacagttatcatgaagtttgggtattctctatgttcagcttatgctgagggcataatttgcatagtttcatttttcttattatttctctttattgcttttagttgtagacaggaacccagacagttgctatcttcctccatgacctagaattctggcttctagaaatcataagaatatttcccactgtagtctgacatgccaaatgtagctgtagcagtaattaaattggtggggggattttagtaattcggttgacagcttttgggaaatgacattggctggattaaagaccataggaaacccagaaagtttttatgctgctatactagtaaaactgccattaatgtggactgttcaaaatgctgaaagacatatggaacctcaactttctacaggcaagaagcaggctgagaaagtcgttcaaagggtatattttttcatgttctcttcaaaaatggccaaatagggtgatggaaaaagaagaattccaagaacatggagccaagggctgtggaaaacaactgactgaggagccactcccaggaagccaaactggggcattatcagaaaatattattcatcctaaaaatagacccgccatccagtgggattgtagaattgctatgtaccagtgagtacaatgtgcctcctctctttccctgtgtgaatggcagtgtttattgtgactattttgcctgatttcgcctgatttcaccactatatgatgattcgtcttttaattcataggcctctagatggggacgacccatatctatacttgtggtggagagtgtgttgttctgcctagatacccctcaggaatgaaggacttatgttctcatctgctgggagtgctcgtgaaagatagtccttagttgtcatccctcctttgggcttttccaatggcttatttcccaaggtcatatattcttacagggactgctctgattcacgttgggcatgaagttccagccctttatacccaaaattatgaggggccactctaagctgtagaatttcttttgggttacctggggctatcttggaactgaatcacagatcaacatctccatctgtctgatccttcttttactgttttctacaagtgtttgtctcaagagtactcccaaataattatagggcgtgctaatttctttctcaggttatacgttccaggaaacctaatctgcatcaagtcctgatatatgtctaccacaagttgctgaattttaaacttgatgctctgtgggatgagatgttttagggagtcttgtgagtgtcaccactcactaaatatatctcagcatgtatgtgggaatgaataattgtagtcatgagtaaagactatggtagatggtaaagatggctccattttttcactgctccctatattcatgtcttttgccatcttactttgcagtgttcctccattctgacacagtacatggccacgtaacttgctttttcctaggaggaagtagaagtggcagtgtgctaatacaaacctaagcctcagaatgtcttatatatttgctttttgttgttggctttagtttttttttggctgtttcatttctgcacttcagcctgctgggaactgggaaatagaaggaatatagccaagccatcaagatcatccaagctgaggccagcatcaaggagctggaagcctataaatgcagatatatgagcgagctctgctaacatcagtagtgctcccaactgactactccagacgtcgttagaacttactgctgtgtactactgtagttcattttgtggttgtttgttatgcagcattattatagtaatagagatgggatacaagggaagaaaaaactatgatgtgtgtggatgcccccttggtctataaaggtataaagatacctaggtgagtaaggtaaagatcagagtgtcagtaatattgaggagagaggaggactgtgtctggaacaaggcttatgaagagcggctcaagtggctgaaaaagttatatttcttaaactgggttgtgtttagaagggtggtaatcattcatttagctacacatttttaaatgtagattttctctacttattgtattttatggtgaaaaggttaaaataattttttaaaattacacaattcaaggctttaactttatagcaagagaaatatatatcctagagaggttaagaggaacaaatggaagttagcagcaggacaaggattagcatccagaccaaacattatgtgaataaatgagaaaaataatatcaataaaaggaagtgatattttcatagagaaggacacagaattggacgtagtggctgatatttgtaatctcagcagtttgggaggttgaggtgggaggatcacttgaggccaagagtttgagactagccygggccacatagtgagaccctgtctctacaaaaaaaatttttaaaaatagctgggtgtggtggcatacaactctagtcttagctacttgggtggctaagacatgaggattgcttgaacacaggaatttgaggttgtagtaggctgtgatcgtgccactgcacttcagcctgggcaacagaacaatatcttacatctacagaaagagagagagggaaggacagaaataatgagctatggaaaattgcacactaaaggtgttaaaatgtttttttatcaggggaggatacgaaatctttttctgaagttttcaagaaaatcatatttttgaaatgataaaatgtatccctgtcaagaggtgagagtttctattaggaaatggttgttaagcatcacaattccgtgtctccctatctaaacactttctatacccaccaagaagatagattcacatgatccatgtatgcaaaatcttattgacagaaatggactttgacctaggaaattttccatcctctctacccaggcttccagggacaccatgaatgattcttttagccttagatgatgtattcagaaccccctcttttacattataaatacatggctcacgttagaaaaattcttgtagtaagcataggttctaccagaacatgtatatcttatttgctaactgcaaattgtactctagacagttattaccagtggtgttctcaagtctgtctagtgaacgcctcaaatacattttattgacaaatgtcagaagttactgcacaaaattgtaaagccgtttggttctgcaatctgtaagattattcttcagtagaatcaaatattttacttaaattctcccctaccttctattacctttccatatatttttatattttgttagtatcagggttgaatgatatcaaacaggagtatctactaaaattattagtgattctaaataattagtgtgaatatgcaaattcagaaggttcagttggtatttttacagtttaccatgactcaggttaaacatcaacaggtgtggactcttagagtctatgtacctggtccatttgccctaggttaaaatgaaggaaacaactgatacccccaaaatgtggaaggacttgcccaagcttgttaggtgttcatccagacctggaaagaatctaccttatgataggccagtcctcttttcaatgtactagtcaggctctcattaactttgacagagaagatgagaaaatttatctttaccattaaaatggtgtcttaataaaaacggtgtgtttccagaatttctcttaggggaggtttggggagagaatatggcaatggaggtggcttaggtgcttgttttgaaattgcacttaaaagtaagataaggtttttacttagattgggggtggggtggggtggagtagcaaaatacctcttggcttctgcactgattaagactaattattattattattattgttacagggtcttactctgtttcccaggctgagtgcagtggcacaatcagggctcactgcagcctcaaactccccggctcaagcaattcttctgcctcaaccacctgagtagctgggactacaggtgtacaccaacacacccagctaatatttttattttttttgcagagacaaggtctcactatgttgtccaggctggtctcgaactcccagactcaagcagtcctcctgcctcagcctcccaaagtgctgggattataggcatgagtcaccatgcccaaccaagactrattatttttggaacctgttttaagatgtgttggcattctcaatcaggtttagaatagttgtatagactatacacgaagattcaaaacatttcttaaaatattctatttttagccagtttgcatttaagtactttaaaaagggggcatttcatcagagacaatgctaggtatatttaccttactatatccatggctctatgttttctaacactgtgtaatttactcttttctaatagtatagaaggaggctatgactcttaagtaggcagtttgagaaaagaaaatatctaaaagctgctctttagggataaactgataataacaacaaagtgttattaaagaaactcaaagaagttacatatacacctgctttttttttctttttcttttctttcttttttctttctttcttttttttttttattttttttttatttgagatggagtctcgctctgttgccaggctggaatggaatgcagtggtgggatcttggctcactgcaacctctgccttccgggttcaagcaattctccagcctcagcctcctcctgagtagctgggattagaggcgcatgccaccacgcccagataatttttgtatttttagtagagacagcgtttcaccatgttggccaggctggtcttgtactcctgacttcgtgatccgcctgccttggcctcccaaagtgttgggattacaggcgtgagccaccgcacccggccccatatacacttgttttaaatcaacatttctctgtgtggataagataaaaattcaatgtgtattctctgtgaagcacacaaaaggacaagtcttcaatttaaaggatctaatagccttcgagtctcttgagaatctagattaatagaggttactcagaaaattgcagaacataggaaatccagctagtgaacctgtaacacttggatccaaaagctaaaatcctctcatgaggaaaagcaaacaaagacaaatatccacagatgtaataaaatacccatgacataagtatttcctgttgtgtttttggcttcacaaatacagtatgggtttatatatctatcaattatatcaacttaaagtgtagattatggaaaaacctacatttattatcaccatccaacagttcccatatttcctcatgatcctgttacctataagcatcaaaatgcaaagctggcttccacctgtggaaagtcgtccctgagagtcattattttccttttaacattgacatcatacactttgacctaaattaggaattaaaacactatcagagcaatcgttaaaattttataaggtaaacttcagttctttcttcggaggatcagaaatactcatgtagcctccatctaaggaatccaaggtgcaggaagcggaatgacgtaccagacatgacacagcaataagtggaagggttttgatgaggatcagtgcttctctgagtaaggtgaggctgaagaattgaggagtctctgccagccccaattaactcacttctttgaattctactgatggagattgttctgggaatatctgagataaaatttatctttgcaataactgttatttttaaggaaaatttcatgaacgaactaacagcaagtacaagattttggagactaacataatgggtgattattatggctacttaagctaacaaacttttaagatagaacaactattttgcatataaatattaaatcaagtgttttccattcaattcctaatgaggaagctttcctactggccatagcggatacctaacatcacttactagctgtttctttgttactgaacatggcaggagggggcatgggggggtgtcatgggactgcctactttcagaaagttcagctttttgtatttcatataacagcaaaagtttacaggacttggaagttcatatagtatttatattgtgccaagtagagctcttaacaagcaattactgtatacaaacaccttcattaaaaaaatgagaattttagatgacagtcatgtgtatcatttcttaaagataacctacaaggagtcaaaggagtttctctgtttggccaacacagaacagctgatgaataaatatattcataaggagaaactggctgaaaaataaaataccagtgctttgtaaaagcaatgatggaggtgagcaaatcctaatcttaaatgagacataaaaaggaccgcacgtcaattcaattgtttaattagagataattctcagaagaaaaggggttaattttttcaaaataaatgattcaatttatgataagccctagaggctttatgctaattacaagttattttaagacttgcggttgtaagcacagtttatggttacctctgtgagagctgtttggatcatgagagctctactttatgccttgttttagctgcttgaaatgagattttgttgttgtgcaggaacactaatataaaaagcagaatttgtgtgttttgttggtacgcatagatcataactgtgggccatgaggaatgtgcagctgttctttcattgcactaggaaggaaaatgttttgctgtgttacaagtctgtgtgcttataccttcctgacttgctcctttcagaataatttccccagagtcaaatcccaggcaagtgcagcctttacatattgagatgggcataaatgctagctcgaggctttttctgaagttgtgaaaggttgacagtactttactggttggctcaagtaagaaattatggaggttttcatgtcagaacagctgcacttacattttccatccaaaacacttaccaatttactcaaaattaggagataattgaaaagcagtttcataacattctggctttctaaaagaaaataaaattgttttaaaacatgcaaattatattgttaattgctgagtgtttttttctctcatagtagcggttgtgcattctgtctatgcctgcttggatatttatgttgagtaactacatttgttttgttttcagttataaaatgttcttttacttgagtaagagcaaattcttcccttatttatttttccagagatgtcatgctcattatgtatgcatttgggtgtaactacaacaaaacaaaatggattttcataaataaaatttacatagctgaaaagagcacattttatctccaagataagcattgccatcttttttctgattgttgctctgtaattcttctgaacaacaaaatgaaaataagtcaaaatgagaaatcaattctgtctctttataaaatgtcaaatatgtatgtcaaattccctaagaactgtaaatggctcttagtatttttaaaaatcctagatgtaattacattaagtaatttggtttccaaaggagtttgaataattaaaaagcacttgctgattttcttcagtagactaaaaagtattttaataatgcacaaatagcagaaattgaaaaaagacttaaatagaaggatcattttaactaaccaatttatgaattttgaaatttcaagcttatggtgtttataccaagacatgctacctattagttacaggcagatgacattagtgagaaatcagttatatgttaggcttttaaaatttaactcaattctaaaagctttcctctctctttacatggctgttccataaccatatgggagacatgaactccagttgactctggattacctacggaattggggtgagggttagtatggataaatgaaatccacagataatcttaagacattttagctttcatctccccaatctcccctgcctccaaattatttcagccgctgagatgcagcaaaatgtaatatgtccttgttttatttttttctcttatgtttcctagttttctcgattactttaacagaagtttagggaaaactgagtggtccgtgtgtaggcatgaggcaaaaggcattgaatttagatcctcatccttaaataggcatgactgtatgagccatgctgttttcttgcaaaccattttttttcttgcccctgacaaattgtaacctgctttctctggtgaaagcagttctgacccttttccatccctaataactgcttggaacctgactaagataaagggtcctgctgctgcagacgccagcttacagggcacaatcagggctagcattgattggcaatggttcattacccatggggacagctgccctgtttatcatcctaatcttttttggacccaatgttttttgttttttcacccactctgtggtagagctgaggctggaggaggctgtgcttgggttcatcttaccagctggaaagaatgaaaacgtgaccaaacacctgaaaaattgccacctggccacacaatgactttaatgagactggctctcatctccttctgggactgcaatcacaacaagacaatgtttgttagtttttaatgcaataatcagttcttttgaaggaaagcactctatgtagggttaggggtggctgggtggctaaaaacaaactgtgttttttaaaaaaaacatcaactgctgctaaaaaccaatgtgttcattgttttttaaagtcaggactatcatgtaagtagacattgcttttatttcttttgaaaaagaagaggctgattcaaatcaagaatctctcagtttatttctttgtaataatttatacatttataaattcaatcatttctgtattcttcctgtgaagaattattataatttatctggctctagagaaaaataaggacttgggtatccaagatttaaaccttcagtatctaaacaccaggaggtgctctaagataacatgaaacaacacatttccccgagatttacggattctagttacatgaaatttactgacaaaactgtttgctctgagaggccctaaacgttcagattctaaggtatgcagtgtagtagaccatcttctggatctaaaggactctttcaagggagaacagtagccctgtcaagatttcggggacattagtaaaaatttgcagagagatgttttctacatgcctatgacctggaactatctgtggaagatggtaaacaaagaatgttaatactragtttgttttgtgttacacagtttaaaatgcggtgagaaagccaggtgagactatgaaattttggagctggtgtattacattgtgcatggataagtactgtatttgctcttccaaaccagagatcaggtgaaattatgaagacaaccttttcaggtattatatagggagaaattaaagagaaatttatttgtgtttttatggataatcaataggatcctatcctggggaaagcattctaataagtaatttaaaaaaataagcttcattgagttacaatttacatacaagaaaattaatacaatgaattttacagttagaaatgcataatttgatgaattttggcagatgtggatagtcatgtaagtaccacaaaagtcatgatatagaacatttctatcatccaaaaagagttctttcatgttccacrtcaattaatgtcattgctccacaccttggaccctggtaactaatgatttgttttctattgctataattttgccttttctggaattttatattcatttttttttgtggccagctttttaaacttttcatactgcttttgagattcacctatgttgtatgtattaatagctgatttctttttatgacagagtagtattccattgtatggatgcattgtaatgttattatacattcacaacttgatgaatattgagtttttttccaattttttggtattatgaataaagctgcaatgaagatctgcatgcaagtctttgtatagacaagtgcttttccttttctcttgggaaaatacttgggaatgggatggctagaacatatagtgggtatatttttaactttttcaagatactcttataatatttttcagagcatttgtactgtcttacattaccgccagtagattataaaacttccaaattctctgcacctcaccaacacttggtatggtcagtctttttaattttagccattcatagtggttgtaacttgcatttacctaaagatacactgagaatcttttgtatgtgtttgttttacatgcatacattttctttaaaggagtttcattcaaatattttgccaaattttaattgggctgtgttttcatattattgaaatttggggattctttatatatcagagtacaaatgctttatccaatgtaggctttgcaaatattttcttctagttcatggcttgtcttctaattcattcttttcaaacaacaaaagtttttagttttgatgacatcttctttatcattgtctttaatggatcatgctttctgtgttgttgctaagaaatcttggcctgatccaaggttacataggttttctccaaagttttgatctaaaggttttataatttcagtttttactttaagcctgttatttgtgttaatgttatatatggtgtaagataggattaaaactcatttttttcatattaatttcaaatgttttcagcatcacttgttaaaaaagattatagtttcctcactgaattgcttttgcacatttgtaaaaaaaccagttgtccatatgtgtgtgcatttatttctggacactgcagttaatctaatgacctatttctcccatccaaatattagctaggcctgactctgcttagcttctgagatcacatgagagcaagtacatttagggtggtatggttggagactattgacctatttctttatctttataccagtaccactctgtcttaattcctgtagcctgggccaactacataatttttgggatctagtataaaataaaaatatgggttcctttgttaaaagttaagaatgtcaagacagagacaaagagcattcaaccaagcacagagctcttctgacagtgggaccttgtgcaactacacaggctacatgcccatgaagccagccctgatcacagcattataatatgtcttgaaataaaaatcaggcagagttagcatttccactttattcttccttttcaaagttacgttgactagtccaggatttttgtatttccatatgaattttagagctagtctattttttttttaaaacaaaccagtggaatttttattaggattgcagtaaatgtatagatcaacttgagggggatagatttctttgcaatattgtgtcatcagaccaatttagggctatgtgagttatttatcttttttattattattaagttgtagggtacatgtgcacaccgtgcaggtttgttacatatgtatacatgtgccattttggtgtgctgcacacattaactcatcatttacattaggtatatctcctaatgctatccctccccgctccccccaccccatgacaggccccggtgtgtgaagttccccttcctgtgtcaaagtgttctcattgttcaattcccacctatgagtgagaacatgtggtgtttggttttttgtccttgtgatagtttgctgagaatgatggtttccagcttcatccatgtccctacaaaggacatgaactcatccttttttatggctgcatagtattccatggtatatatgtgccacattttcttaatccagtctatctttaatgaacatttgggttggttccaagtctttgctattgtgaatagtgccacaatgaacatatttatcttttttgagtgagttttgtagttggtgtctattgaggaactgggccatgtcatcaatgttgtcaaatttcttggcataaagttgtgtccttccttattcttttttcatatatgtagcatctctgttaatagcacatctgtcattactgatattggtgatttgtatcttctcttttcttgatgaatttgactagagttttattaatgttattgattttctcatagaatcatttttggtttcatgatttttaaaatttaattgatttctgctcttatttcctacttactttttacttaattttctcttcttttcttagtttcctaaagtggaaactttcagatttgaaccctttcttattttctaatatggatgtttagtgttacagtttctccactagttattgtgttagtggcatctacaaatattgatgtattatgtctgtatttatatttcattaaaacggtttctaatttttaaatttcttctttaatctatgggttatttagaagttgttatttagtctctaaatatttcaggattttccaaaggtttttcccttatttatttctaatttaattctattgtggtcagaaaacatttgtataacttaaattcttttcatcttatggggatttgttttatcacgaagactctggtttattttggtaaatattccatatacatttgagaagaatgtacattctgctgttcttgtgtggagtgttttatcaattccatcttgggcaagctggttaatgtaggtcaatgttgtcgaaaacttttatgtcttcactgatataccagctacttttcaacccacttttgagagaagggtactgaaatatccaactgtaattatgggtttgtctgctccttataattctatcagttttttccttatatattttgaagttgtgttgttaaatgcaaaaactttagaattgttatgtctcctgatatatgttgaattcattaacaatatgtgatgacttcctctattgtcaataatattcttggctctaaaatataccttgtcttatattcattctggtttttctttgatttgtattagaatggtatatattttttccatcactttacttttaacctgcacacaagcatttaaaatgtgtttcctgtgggctgcatatagttgtgccttgtttttaaatccaatttgacttagacactattttcatctagaaataaatttgacaatttattttaattgaggatgtttagaccatttacatttaatgtgattattgatacagttaagtttcagtcttttttcttgtcatttgttttctggtcctctgtactttgtttaccctttgcaaatttcctgtcttctttgggatttaacatttcttatgattttatttcattttctttgcaagtttactagctcttactttttgtttgttttattgttttagtggttgctttagagtttattttatacatattcaagttatcacagtctaccttcaagtggtattatatcacttaatgtgtagtacaagaaccttacaatagtattatttctatttctttccttttattctttatattattgatgtcatgtattttattatacatatgttataggtattataattcattgttattatttttgtctaaatagtaaattatcttttttttttttaattttgagacagagtctcactgtgttgcccaggctggggtgcagtgacacgatcttggctcactacacacctggcctcccaggttcagacgattcttgtgcctcagcctctccagtagctgggattataggcatacaccaccacacctggttaatttttatatttttattagagatggggttttgccgtgttggccaggctggtctcaaactcctggtttcaagtgatctgcctgctttggcctcccaaagtgctgcaattacaggcgtcactgcgcctggccagtcgattatcttttaaatatatttaaatgaggaaaatatctcatacatttacccagacagttaccatttcaaatgttctttctttaaaatagattcatatttccatctggcattattttccttttgcctaaaggacttcctttaatttaaggaatgtttaaatatgtttaacatatctgtactgtgggtttgctggtgataaattttctgtgtttttgtgtgtctaaaaaaatcattatttgtctttatttttaaaatttattttttctgtgtatagaattctaggttggcaatttgatgtttattcattcagtactttaccagcacttcactgacattatttactataagaaatttgctattattattatctttgttcctatttatgtatcatgctattttattctgatgtgttaagattttctctttattattagttttcataaatttaattatgatgtgccttcgtgtagttttcttcatgttttttgtccttatagccactgagcttcttgaatctgtggaattataattttcattaagttcagaaaaattttagcctttttttttgtatcgtgccctttttctttacccttttggagaattcaattacctatatatgagctatttgaagttgtcccacaggataatactattctttttattcatttctttctctatgtctttcattttagatagtttctactgtgatgtatttaagttcattaatcttttcttctgcactgtcaaatttgttgtgaatcccaatgaatattgattttatcttagacactattttcatctagaaattttattggtattatttttatatcttccatagctttgactgttagtatagttgatagagttatattatctgttttaatgtttttgtctgttaattctaacatctgggtgagtttgggtctgattttgatttttcttatcatcatggctcatattttcctgcctctttgcatgactggccatctttgactggatgcttgaaattgtaattttatattactgggtgctagatatttttatatttctatcaatatttttgagctttgtttttggattcaggtaagtcgcttagaaacagatctttttgcatcttgcttttcagatgtgtaatgcaggagcagtacagcagtttagtctagagttacttatttctgaccaatgaggcaaagtccttctgtgaactctacttaatgcccctgaattatgagattttcaagtcaggctggtgccaacaagaaatattccaagaactgtgtacatgccagatttccgctaattgttttgaatggctttctggactcagatggtttcctcacatgcatgtactgatcagtactcaagggagactctctgcagacctctgggatctctttctgctcaacattttcttctccagaactcttccctgcaaaatctagctaccttaagcatccttagatttttagttccacttctactcagggagtccactgggctttgcatgggttgtccctctctgttctgtggtctggaaattcttttgaggcaatatatctggaacaatcgtatggcttacttagtcggtttcttgtttctttcgcattgctgtccttcattgcctgatgttcagtgtcttgaaagccattgtaacgtatattcttgtctgttttcttttgtttcttgttatttcagctgggaggttaaatctggccccttcttaactagaaatagaagcaattcccatactctttttaattttttgatattatttatcagactttgggtttgtttagatatctgtctattttctctctcactggagatcaggtactctgttgtgttcacattttttgaacattagtgaatgaataaatgaatgaagtatatgatctaaaatgacaatgaacatagaaatcttgaaactttctgtaatcacctaccaagttatcttgccttataattgttttatgttgataatcagtggctcttttctaaagaatttgcaacattttattgataattgcccactgtttctagtggtaagaaaagagtcctttctcctcagtttgcagaagaaaaagtagagcatttaaaacttttttagagtgtcaagcaaaggttgtttgcattataaaatcaatgaaaatactgaagcttttcatctctgaaaaatattgaatatgtaaattagggcacaaattttagtttgctcttaggtagtttgatgataattatgagagttatattatttaaatctaagctcttgagagttctttcttttttatatttctaagagagcccaaccttatgttaatgtacaaattctttttgagtattagtgaatcaatagttttcacaaattatctaactcctcattatcctcactttccagtatgagaaatctcatttaatttaagataagataatatctgttactgtaataattcagttctgacaaattttaattttattttaaaatactggcagaaggtaaaatctcaaatatgaaattctccttttgactttatctatctatttatcttttggaactcatggttttccacttgcttttttccattaacatatcttgaagattttttctctattagcttttataattttacctttttcttttaattgctgcagaatatttctcatgtacatgtattataatttacataatcaatcttccattgaagttttaaatggaattctttgtgcaactaagaatattactatcaaccacacctttttatgtttgatatgaaacatctgtgaaccttttaggatttgtatttaatttaatgaattttctggaatttttggaccattccattggggacatttagataatttctggccaagataaagtgtgactgctttgaaaagtctacaaaagcaacctttacaaaagcttctcttggcaaagcacagcctagaaccaagccaatagcatttttcagcttcactgcattcatggcttttgaggccatgaggtgtcagtatcctttctgtagatgtttcagaagaatgcctcaattcatatttcacttgtgggattttgtagtttggcataaatgaacactacaaataggttctagtttggtgaccatatattacaaaaatggttggattcatatttatgtatattcgtgaatttcaggttttttgaaattgatatccagcctgtgaaatcaggtgtaatgttttcaaaagtaaaatttagtattactaacacgtttcaaatactattttataatacacttgtttattagtctgttctcatattgctatataggactgcctgagactgggcaatttataaagtaaaaaggtttaattgactaataattccacatggctagggaggcctcagaaaacttacagttatggcagaatgggaagaaaacacatccttcttcacatgatgacaggaaagagaagaatgagagccaagcgaaggggaaagccccttacaaaaccatcagatcttgtgaaagcttcctatcatgagaatagcatggggaaaaacacacccatgattaaattacctccacctggtccctcccatgacatgtggggattatggaaaccacaattcaagataagatttgggtggaggcaaaaacaaatcatatcattccatccctggcccctcccaaatctcatgtcctcacaattcaaaacacaatcatgcctttccaatagtcccccaaagtgttaacaaattccagcataactcaaaagccaagtccaaagtctcatctgagacaaggtaagttccttctacctatgaacctgtaaaatcaaatgcaagttagttacttcctagattcaatgagggtacaggcattgggtaaatatacccattccaaatgggagaagttggtcaaaacaaaggggctgcaggccccaataggacagtcattaaatcttaaatttccaaaatcatctcctttgactccatgtctcacatccagggcactctgatgcaagaggtggtggccttgggcagctccacccctgtggctttgcagggtacagcccccttcctggctgctttcatgggctggccttgagcgtggcattgccaggtgcatggtccaagctgtcagtggcagtaccattctggggtttggaggatggtggccctcctctcacatctccactaggcagtgccccagtgggactctgtgtgtggactctgactccacatttctcttccacactgctctagcagaggttcttcatgaaggctccacccctgcagcaaacttctgcctggacatccaggcatttacatatatcctctgaaatcaagatggaggttttccaacctcaattcttgacttctttgcactagcaggctcaacaccacatggaagctgtcaaagcttggggcttgtaccctccgaagccaaaacctgagctgtaccttgaccccttttagttactgctggagtggctgggatgcagcgcaccaagtcaataggctgcacacagcaggggggtcctggacctgctatcaggaagccattttttcctcctaggccttcaggcctgtgatgggaggggccaccgtaaaggtctctgacatgccctggagacatattctccattgtcttggtgattaatatgtagcttcttgttacttatgtaaacttctgcagcaggcttgaatttctccccagaagatggggtttccttttctattgcatcatcaggctgcaaattttccaaacttttatgctctgcttcttcttgaatgctttgctgcttagaaatttcttccacaagataccctaaatcatctctctcaagttcaaagctccacagatctctagggcaggggcaaaatgccaccagtgtctttgctaaagcataacaagagtcactgttactccagttcccgacaaattcctcatctcagtctgaaaccatctcagcatgaacttcattgcccttattactatcagcattttggtcaaagccattcaatacatgtctaggaagttccaaactttcccacatctttctgtcttctgagccctccaagtctctaggaagttccaaactttcccacattttcctgtcttctgagccctccaaagtgttctaaactctgcctgttacccagttccgaactcactcccacatttttgggtatacttatagcactccactcctggtaccaatttactgtattagtccattctcacactgctataaagtactgactgagatggtaatttataaaggctaaagatctaatttaatcacagttcagcatggctggagaggcctcaggaaacttacaatcatggtggaaggggaagcaaacatgtctttcttgacatgatggcagaaaggagaagaatgagagctgagccaaggaggaaggccattagaaaaccatcagatatcatgagaacttattcactatcatgagaatgccatgtggggaaccacccccatgattcaattacctccacctggtccctaccgtgacatatgggcattatggaaactacaattcaagatgagatttgggtggggacacagccacaccatataagcttgatcaaataaacttttttcaaaaaaaaaaagaagaacagaagatcattttgaaaataacaaaaatgtgccacacatttaatactttttcttctaaaagctttagatgcttccttagatatcatcaaattatatgtcactgcagtcctggaagaaagatcagtgataggaattgtaggcatttatgggcttcatggttttgtccaagataaaaagaggaacccctatttattgctcacatcctttagaaaagtaacttaccatacattgtctcttgttagcctcagaacatcaacgtaagggaggtattattagccctgaggttcaatgacattaagagtttaaacaaagccatacacctagaaagtgaaagtgagggtttgaactcaggtctttcttttttcaaatcttgtgctttttcctccaaaaggaatattttttttccactatagaatacattttttgtgtatgtgcacatgcatacatgtgtgtatggagagttgctccagaattctcatacatttctatatcctaatgtaaagggaaaaaaaatccacatagcctatatttgttttgaacaggaaagaaaataatttttttttttttgagacggtgtcttgctctgtcacccaggctggagtgcagtggcacgatctcagctcactgcaagctccacctcctgggttcatgccattttcctgcctcagcctcccgagtagctgggactgcaggcgcccaccaccacgactggctaatttttttgtatttttagtagagagagggtttcaccatgttagccaggatgatctcaatctcctgacttcgtgatccgcccgcctcagcctcccaaagtgctgggattacaggtgtgagcctccgtgcccagcaagaaaataaattgataggagatggagtccttactaagaatttgattttttgacagtttaaagaaaaacacatttttaaaaatatatattccttctttgattttcactggaattagaaaaaggagaataatgttctcatgagagaagtgtcctagcataataaaagcaaagcctaagaatgaattgtttagtaagagatttcctgtggctaggactggaggcaaatttttttgaacagtactgtctgacatatattcaaagttgtttactattctatgtgatcattatcctctttgtctttaaatcttcaaattggttacatataatatccttgtgtttgttttaatttgggtaatgagggagaagatgatggccatggtgggcaaaataagaaagggcttagcagtacagaaggctaaccatgaacagcaatcaaggattaagcaggggcagcaacttaaagggggagggagaggagatttcacttctcttccagatttccattctgttcttctcagagaatctgcagcaatattagaacactagacttctcatagtaagtggaatggggactaaaacctaaaagacttgggaattctggggaggagggtggaagacttggggatatttgatttaaataactttcataatcattaggctttcttgttttaccattttgggtagctataagatacctcacaaaaatattcctgtagttaccttcagtatctctgaagtgataacttattaataaaattatcattagtgccctcatgagacatagaaaatgcttggttgcattctctcttcctttatttcctctttctttttgcatatttggggggtatgtgtctatctgccgatgggcagaattttttaaatatagcaagtggcttcctaacaaggtgtttaaaattcataatgaacatgttataggttttagaaacaacctcattgttaataagactgagaacttgaggcacaaagagagtaactcgtttcagcagaatgtggaatataggcacaatagcatgaggtaaaacaagctgtagtatttgctagattatataggcagtcaataccattgccttcatgtaatttaattcttagttttgattttctgttgaagtaattgatggaagatcaacataaattaaataatattttcattttttcttaaagacaagtaatacaactctgttttgagaaaatactatttaaaatatctatttttaatgtaatgattcagttatctatttctttgagttttcctaaattaagttttgctgttaaaaaaccttaactagataagcatctgttccttttgcatggttggagtctaccctcttcctaagaataaactcatttcagttatttttctttaataaagcctgctctaagactgccatttatgattctcaatttgagtggccttttctcaatgcctgcaatttaagtacataatattttctattgtttttcctgcttactctagtaaattactgccattgtctcctgatctacctactgtttcaaatctaaattgacaatacaaaacaatttgaatatttggaacaatatttatcctctaacataggtcagatattaataaattcttacagaatccccattaagagaggtggctgtgtcatggctaagagcatggacttttaaatgaaatgcctggattttaatccaggcttcaccacttacaattctgtgaaactggacaaattttaaaatctctctttaaatggttaccacatctggaaaatctcaatgaaatagcatatttcctatctggttgttgcaagaaaaaaatatatatatatatatgtgccaaattacagcaaaatctatcccatggtatttcatgtattttacattaaaaaagtacactaagaagcaaattcatttaatagtcaaaataccaattaaaataatctctaatgcagtggtatgttgatttaaatcatccttaatgttatctgcagtatctcagttgttagaggagattatttaatccatgaataataatatattattgaaagcacaagtatattggcatctgtcttagtcagtcctggctgctgtaacagaataccatagactgggtagcttaaacaacatttattcctgagttttggaggctgggaagtccaagttcagagcaccagcagatctctaactcttggtgcacatcagtaacccaagtctcctctccttgagtgtggatggaaactgtgatttgtttcttaaccaatagaatatggcaaaggtgataggatgtatgtgattatgtgcatgtgattatataagattgtaatgcgtgtcttgtgaaaagcctttcttttttgttggctttgtagaggaaagctgctgtgctgtaagaagtccacagggcaagaaacttaggccctcggtctggcaacccacaagatactgaatattcctagtagttacatgggcaaagaagtggaactttctcctctcaagctttagagaaactactaggctgacaccttggttgtagccttgcagaatactcagttaagctgtgctcacactcctgactcacagaacctgtgagacagtaaaagcatttttatggtactaagtttgtggtaataggtaggtaattaacacagaatctttgctctgtagtggcagaaagcttagcaaaattgtctcctacaatttatatggaaagaagaatttgtaaatatcatgcacatagttatctagctaaggagatttttgaggaaagtattgaatattctgcctaatttcttcttgctgcttacggtaagatgcaagaggagaggtataaattgacagaactgttaaacaaaaacaaacaagggctggatgacttaggaaatgctcggcctctccagagacaaaaaaccccatgacatttgagaaatgactccagtccctgccacaaatgaaggtctaaagaaaaacatgggggtgtgattgtacaaccttttgttaaaaacctcggaaaaatcaaaggactagagtagtcttcagttacataaactgccctttcaagagattgaaattgtgcctcatggaactttttgattaaatgatagtatctctaagaagttaagtgtattgtccttttgtctaatggagtgaacctcagtgaaattcacaggagtcctacgaagtatttgagaaaattgttacagcaaaagcaatgttaactggaactgaaagtggcagagaataaaatgtgaaagaggcttctggaccctcaaattttaggcaggagcaggctgttaaaattactcagctgcaaacatgtactttctctctctctcacacacacacacacacacacacacacacacacacacacacacacacacgaaggatgattcagagggcaaagctgagagccatgaagaattatcctatgctgagaaacctagttaagaacatttttaaatttgccaggctggatttcagaattgctatggaccagtgacgactttgtaccttctatttcccccattttgaacaagaatgtctgtatgtctatagatgttttcttatgcctgttcaaccactatatgttgggtgtgtgggtgggcaaataacttgtctttttagtttgacagattgacagatcaatttaaacagccttcatcaatgcctggacctgatttagataatacaattctggatattgtgcagatgctataacagggtggaactctgggggaccttggggagaggatgagtgtattttgcacgtgagaagaatgattcacattcttctcacgtgcaaaatacactcatcctctcccaaggggggccagagggtgaactgtggcagacagaatgtagggtgcctccatggtctccacctcccacatatttatgcctttatgcagccacttttccttagtgtgagtgggatccatggctcacttctaaccaatgtcaaaagagatgtatgtatgtaattacatgaatgtgatttagtcacatatgattgcaattgtatcttgcaaggtgactctctttttcccttgctggctttgaagaagcaagctaccatgttataagatacacatgaagagggtcccatggcaagaaactgagagcagcctctggccaatagccaataaggaaccaagatcctcagtccagtagcctacaagaaactgaatgctgccaacaatcacaggagtgaggaagcagatcctttcctaattgagccttagagaggaaaccctggcctataccttgattgttaccttgcagaagagccagctaagctgtgcctagactcctaacctatataaactgtgaaataataaccatgtgtttttgtaaggtaccaactttggggtaacattgttgcacaagcagtcaacaatgaatacatagaatttactaaaatgtaagtttcatgattgcaaataattttgcacatacctagaaatgggtctggaatttggaggtgttcagtaaatattggtaggaaataaagaagtcagaaagaaagggaggaagcacaggacagccactgagacatcagtgtggtcttgcgagcagactattgatgtgtcatgtgatttgctggtacaaagtaagtttggtaggatgtgctggaaaagtttttttctacatgattttgtatctgtgtcaaatgaatatggttatttacatattgagttgagggatttacatgtaggtgtttggttaggaggaagaaatgacatggatgtcaagtttacaatttctcagtactaccctattccctaatattgtgataagaactagttatagcagtccaatctcaagaaatagctccactacttctcacttctgagaatatatcatgattatatattataaatatataattatatgtattgcatatattatatgtaattataatatgtattattgcatatataatacgtaatataacatataatatataattatatataatacatatataattataatgtattttattctcagaggtgataagtggttattatataagaggtggttatataatatataattacatataatatatagtatataatatatatactgtatatacatatataatacctgtcaagtaaatggaatcatacagtgtgtgatcttttgcatattgctttttcacttagcataatactgctgaggttcattcctattgtactgtgtatcagcaacttcctttttactgctgaataatgtgctgttgtatggttgtgtcacattttgtttaacaattcaccagtcgatgaacatttgaattgtttcaactttttgtttaatgaaaacaatgctgccataaatatgactcatatcacatgaaagtctttgtatggatatatattttcatttctcttgggtaaatttctaggtgtaaaattgctgggttatatgatacatttaagttaacttttgtcatgctatcttcaggacaagatttagaaaaacaaaaccttgtagtgcttaacaatgctctttataaataatatttcttaaagctcttttgacttgatttgcatgtttgaaaaaaaggtggagtatgggctgcttattttatataacaaggaatattaaatgtataaaaaagcacacctttaagtggaaaggatatgtagtactctagtcaactactgatagaaagtatacatacagagagagattaggtattactttagaaccccaatattacccaaaatgattcacttataggaatacttgaacctatattaaatgaaggtaattaaaaaaaattagatgcatggatctaattatcacacattttgaggaaggaaatataagaagccatttcatatacttatttatataacatctctcaagtgcagaaacataaagctaattagtgtaaattaatgtacaaatagagaattcatagcaaataaaatgagaaactatgctcagaaaagattgcttctattgtaatgaactgcaaatgccttagcattttcattggcttggtaaaaagttcattgatctgaataaggggaatcatgagtgtaactgtaactgtttttttttttttttttccagaaacaagcgtcactacaggctttataagattaataaagttttctaggaattaagtacaaaatatccagaacagctttcaactcgtatgttatgtgtatgattcttcttctcactttaatgttaatttacttatttgtggaattctagcacaaaaaggcacttagtgaagattaaaagtgtagtctttggaataaatataaaaggaaaataacatcgatttagtttgtcttcctcataggctgcaagagattaaaaaatgtaacatgatttaagaaggaaaggcataaattaatgaacaatagatgatgggtctgaagaaaggtatataagatggttgtatacgttcctaagtgttttggtttgtttatatggagggcatcaatattatccctggagacttcttctaggtaccattgtcaaagagagaataatcagctacagaggccatgggtgcaacacggtgtggtatttcttctgttctaagctctaggtatgaaaggctgggctattcaagagaccaatactaagtgcataacaattctttacaataccaagctttttaaaaagtcaccattttttttttggtgtccagatgtcatacatacattttgcaatggtaggaaacttaaaaaaaaattatgtgtacacataaaagattgcgtgagtgtgtctacactaggactaaaatttggggaatttgtaagtcaacttcagcatgggaaaattaactggcaactgggtaactaatgctttttgagtgactaccatgtgctaggcactgttgtaattgctgtatacatgttaacacatttaatcttcttaacagtcctatgatgtgggtataattagggtcatttccatttattggatgaggaaccgtgaggcactgggagttaggtaaatggcccaaaattacacagcttggaagtgctgaggtcaatatttgaactcagacaatctggccccagatcttacattctaaactaatatgccatatcattctctttactgattacactgagtaacttctttgtagaaagtaagatatacttatctgagtattgccctgttatcccaaaatacatactacaataaaaatccttcatatttaccgtatactaattgaatatttgtaatcatttgaaaaaatgtaatacatttccatgctgttaataattatgttgagaagaaactattttgtaacttttttgaaaacggaaagtacttttctgtttaatatcttttaaatggaaaatactttctatggtcgtgattataaactttcctttggttttaattctgtctcagggtttgttggtggtgaacttgcctgattgaaagtcttgggcaagtttgggatattctcactctgacttaagacttcgcaatgcatttgaactcctctgtcctgggcaatgtcaggattggttcaaataattattcataagacataaaatgtaatgagaagaaacattataggcaaatagtcttttagaaccttgttttaaattaaaacatggttttaatttacttgggcattttaactaatgcttaggcattttaaatgcaaaattgatagcatcattaaccaaatgaaaaatcataatatatgtctttcagataaccaaaaagaggtggaaaagtctagcaattgataccacaaagatactgaactgtggtttagccaagtagagggcatagctcctgggagtggaacaagttgcttctgaagtatgagtttataaacctcaaaacaagactagtgacaaattttgcttcaatacgtctaagttaatatataaaataagatttctggtggagaggtttatagatttttcagtaaacaaattgtttttaaacacctttaagctggagaagaagcaactgcctacctgtaagtaattggtatgctaactataggtaattcttttctaggcatcagccaaacctcataaaaaacactactgtggtagttatttcattggtttgaattgtctcaggcacttgcaattttttcaaagattatatttctctgaaaatatcctataacttaacattttcactcttctggctgttctttgcctggttacttcaaggggtttctctcaagtactaccgtaacttacaggatggatgttttcttattcctatctgcaattctgtgaaaataaagcaattgttcagtgggtagtaatatgaatgcaaaaatatgtctccacagaagcattagcataatttactgtacattcaatgaaattaagacagccaataaggaatataattcttatttattttgaaatgatggtaacaaatggctttgttaccttcaagcttcttactggcttaagctcttttaaaattctatggactatataagctactcaattttaagttttcatttttgaattcaagcttttttggttaggtaaagaatagaagtaactaccataaagaagaaaatataatcatctaatttctcctgaactctgtataacattggccattaatctacatcaatatatggtgaagatatgtaagcagaatgtacaatgtataagacatgcatatatcaatataaggtagtaatgtttattttaaattccgcagatccatttagattcctttggttttatatttggtctattttgttactgcctctataattctgcttatttatttcaaattttacaacatctatttctcctttgagaaaacgtagacaactgatattgggatagagtttaaattgtgagaaatattcagttacagtaaaagaaatgcattagaactagaacttgcgtgattttaaattttattagaagtaggtgtcaagttacctaagatgtccaagagacagctgatgggttatgagttaaattttgggttctgcttatcatttcttagaaatcaatttaaggcatcagttttcaatagcttttttatgtataactaaaaaagagatatatgatatttggtaaaataaagatacatggcttccagtctcttgagacatctgtcttcatgaaagagatggagagttcccatttctacttacaagaatgaatgtatgtcataataaagaccagctatcatttgttatatacaaaatatgtggttctttctttgactttttttctggatttagacaaccacagatgacatttatgagaaatgaactacactgaattcaactgagaaagtagaagattctgtatctccattaacttgtgagaggcttatcattccaaaccttctccagacagcccagcgatcttcacattctctcaactccgtggtctatgactgtcatttgtcaattaattgcaaactgagttcatatatagtctgtgtatgtttcagtacacatgtaggaatatctagggaggtattgttgttctgggctctttggaaatatactctgagaccctgagatttacatgaggaaagtttattgaggaatacttttgagaacttgagtgaggaaagcagggatgggcagagggagaagttgaactgtgatgcagttgcaacagaatccctaccaatcccacaggaagggggtctaactttgggtgaggcggcactttttgcctgagggtgattcccaaggaaagactaagctctgaaccactggcaaccaatgtttctgatagctgatgaaatgagagcctcagtctccaagagtgaaactccatctcaaaaaaaaaaaaaaaaaaaaaaaagaggaaacgagagcttcagcctcagtcctgaagctgggatctagcaggtacactacagcatccactacggtaggtaatgtaatgaaggttaatagcacagtccaacagacagatgcattggcttgaaacttgcttctatcatatactggttatgtaggcttgggcaagttacttaacctttctgtccctatgaagcggggataaagatactgcaggttatctcactgagttattgtgaaaatggatgagttaacacatgtaaagcttatagaagttcttggaatatggtgagagctcaacactcgtcagccattattattagaggctgctataaaataacaaaacttgttttcaaatgaacttacctgtatgaatatttgttcctgtttaggtcaggtgggctagtaacaaatacactccaaatctctagttgcttcaaacaacaaggatttatttcttggccatgccacatgtatatcatgtgttgactggtgttttcctcactttaggactcaacctgacagagcagccagtagctggaacattgcccctgctgtggtggagaaaaatatagcatttgaaatgcatgctgactcttaaaacttctacctggaaatgaaacatgccatttctactcgcatttcattggtcaaaataaatcatgtaggtacatataactctgagtgggaaggaaaatgtaatcctgccctcttcctggaaggaaaaccagaaatacttcaggaacagcactaagattatggcaatttaatttttaaaagttatctggggagatatatactcagttctgaaagctaactttttttgagcacttagtatcagccaggcactgtgacaaagagcaatattatgaaatagattctattgcagtaatatcccaatattgtacacttagaaaaaaaaagctgaggccgggtgtggtgtcatgcccgtaatcacagcactttggattgccgaggtgggtggatcacctgaggtaaggagtttgagaccagcctggccaacatggtgaaatgccatttctactaaaaatacaaaaattagctgggtgtagtggtttgcgcctataatcccagctacttgggaggttaatacacagtccaagagacagatgcattggcttgaaacttgcttctatcatatactggctatatacaggagaatcacttgaacccaggaggcagaggttgcagtgagccaagattgcgttactgcactccagctagggagacagcaagactgtctaaagaaaaaaaaaaactgacacttacagaaacttgatcaataccatatatctacaggatggtgaacacaggctcttattcaggcctatctgattgcaaagctcatactcataactaccactctacttccccccaagaacttcagtgatgccagcatgacttgaaattttttcaacacatgttctaagttttttcccaggaactgcttttagagtctatggtttagaggaatctaattccctaaatgtatgaactctcatatgtagtagaaacttctttcttgctcccatgatggtatcagatgggtagatagaccagtagagtggtcctcttccatggagtgggagactgatggacactccatcttcttcggcacaaggtattcaggggttatcttcttccatacagtcagaaggatgccagcgggccaggcctggaagtgatgcacataacttctgcttacattccattggcttgaaactcagtgatagtgctatacctgactataaggaaggctgggaaatgtagttaggctgtgtactaaatgtagacgcatgtactgtgctgtgtgttttcaaggtattgaatagaacttaaaattgggtaaatatacttgaggacggcagggaatctcttaaagtgacttcattgtttggcctgcaatcctctctcatttcagtattccagaatattgtcttattttagtttattccgctctctaacatttagtatcctgtacttcttaacatgttttatagtttggctttgtgctaatggaaagattatggttagaattctttacctttcctttaattttttttttagtatgaatacaggataatacagaggacactctgatagtaattagtaaagaaccctgcattctgaccccagaggagggcttcacatgctccttggccagcactgcatgctttaggggcccacaaggccaccagataactctgaagtctggtgggaaagcaacattttcggacttagcccccagagggctcctaacaaactatatgagtttttaaggagcttcacaggggatggagtggcagagtggattgttgaactggaagggaattttgaaagctattgcaatgaattgcaaaacttagcctttattaatgttttagaaactttcctttgcaggttgggttggagctgttttattgcctactcccataattaatcataaggttactaaaggttggattctatatcacaccatgattctagtgtggtcatcattactggaggcatgaggagtccagtaatgtatatcacttaaaaatttttaaatgctttcactaacactatatattttttcattttgttcactagggagactcagggtctattctccctctactttgtatttctagactaatctagggtttttatattttgttacatggaacatgtatgtataacgtctctaaaagttaataagacagatacctgcaaaattatttggtagaagaaaaacaggttcagctaggttgtattactttcctcaggtcatgtagttggtaataacacctcaaattttgaagcaagttcttctgacttttcattgttcttctccctaactatgttgcttatcatatttgttagaatgcaatctagaaaagtaaatattgactctttgaggatcaattccagttttgagaatagccgaaagttgcccagtattaaaagttggtgactaagttagataacattattttggataaataataaggtatgtttataaatatttttgaagctcattaaattgacaaataatatatatccttaaaatatttgttagcttcaattgacaaaaatgcacaaatttaaaaaaaatgcataagctgactatgtatccatgtgactatcaattattttaagatcggaaccagatctaaggaaactgaaaacagaaactagctgaaagaaaacatgcagagttcaaacaatggccatgtttaaaaactgaacttttcttttcagtgattttttaatgaagtctagtatgcagcactaagtgtgtgacttggcctttgagaggggttattcataaaggtggagggggaatgagcagttattcctatccattatgtgttaggtgatttatttcatttaatccttgtatctgtctatgaaacagataatacttctattttaatgatgagggaagggctcctggttttcagtacctgatcaaaggtcacacagctagaatcacacagccaccataggaggcagagcttgaattagaatcctagtccatctgttccaaagccaaggtctttcttccaaacaatgctgcttcttttcaaagggataagaaaggatggggatgaagtaggttgaatggtggtttcattcatgaatagttgttctgagggtcttagtcattacaataaataacaacaacaacaacaaaaattataaagattacaaaagaagtgaaagtgttccctgctatagactgttcccaaaggaaatatgcaagtctccaaatcatctacatgaactaacaaatacattcagtaagggcacaggaaacagagttaatataaaagaatcaactggttccttgtgtaacagcagcaacaagtgaaaagtgagatgatataaaatcctatttacaggagcaccaaaaatatgaaatatttatgaataaatttaaccaaaaaagttcaagatcactacattgaaaacaataaagcattgctgagagaaaaataaagagggccaaaaaaggttcgtggattagaacactcaatattgataagatgacaattctcccccagttggtcatagagtcagtatgatccgaataaaaatttcagcactcagttttgtagaaattgagaagtgattataaagtttatatgaaactacattaccaaggaaatttttaaaaataagaatggaattggaagacttaccttacttgattttaatacttacaacaaagttacagtaacaaagacagtatggttttggtgaaagcacacacatatagtttagatcagaacagagtccagaaatagagccacaggtacttggtcaatgaatttttgacaaaagtgctaaggtaatataatgggagaaataaaagtcttcaaaaaaaggtccaaggtcaactaaatacttgtgtggaaacaaaattaacatgtatccttacatcaccctacactcaaaaattaaattaaaatgaatcatagacttaaatgcaaaatctgagattgtaaatcttctagaagaaaatatagaaaaatatcttcacaaactagagataggggaaatattttggaagaaaaaagtgcatgaaacataaagaaaacaattgacaaattggatttcatcaaaataaaaaacatttgatttttaaagacaccactaataagatataaaatcaagccacagactgggagaaatgattcacaacacgtatatgaagaaagtaacttatatgtagcacaggcaaaaatacagtcatgactcattaataagacaaacactaaataaaaaaataggcaaaaggtatgaatagactyytccagaaaagatatatggatggcaaataagcacattaaaaagtcactagggaaatattaattatgatcmcaataaaatatctctatatacatacatattaaaatggctacaaatggtaaaaaatgaccattccaaatgttggcaaggatctggaggaaatagaactttcataaactagtttgattgtaaaattgtacaaccacattggaaaacacttttggcagtttctttaaaagttttatacataccctatggcccagtcattccacttctaggcatttactcaatggaaacaaaaacatatgttgacctaaagatagtatacacatgtttatagagttttacttataatatccccaagctgcaaacaacccaaatgtccatcagtggatgtatgaataaagaacttgtgatatatccatgcaatggaatactactcagcaataaaaagaaatgagctgttgatatgtggaacaacacgtacaagtatcaaaataattatgctgagtaaataaagccaggtaaaaccagggtacatattgcatgatttcattttaatattgttaaatgtaaatttatgtatagggatagaaagaggatgagtgattgctcggggaagagctgcgggaatgcatggcttatagataggcacaaagaaacttttaagagtgatggacatgttttctgtttttatcatgatgacatttgtatacatgtcaggttgcatgccttaaatacatacattttcaagtacttcaattatgccttaataaggttgaacaaattagcactagcagacaggtctatagattttccagctgtggagcaagtgagcatccattcttaaaccctaggttaaattccagattaagatggcataaatctaattttgtttactcctgataatcgaatctaaataaaggaattttttaaaagccacaaacctttaacaaacaagaatagggaaatgacaacaataaaattttgaacacttgaatcagattgaaaagtagtaaattacctgagaataccaaatcttcaactgggaatgagtaaagtcaagaatcaactcagctgatgttgcaaaaggctcaggaattatcagcactgactactcttggaagtgggaatgaaaggatgaaggtaaataagaactgtttgcaatctgatttagaagcattagatgcctagattccccctcacctgctctatgatcctatgcactgcccttctctgtccagacatagaactggaagtttattcctgggttgagtaaaacagagagtctctggactggggatgcctggcaaaattgagaatagcttatactgaaaataaggtgctcagagaatatgtgcacaatgaatgctgaggcttgtagcctacttccctcatggacttgagaaacaatagtaggcagacttttccttctgggcaggagattgaatactctatggaatctgaccagcccaagaggaaaacatctaaagaaactgacattgaaggttccagacgaacagcccacccagttctcttgactgtgaaactcttggtacaaaagctgcgcccttggacttatagcttccgtcaactttttagctccctttcctaaatatgagaagacaaccaagaattgctagatagctgatgaaattcctaaatgagatataacaactaaaaaagaaaaatccaatttggtggaaagaatacttttcaaaaactctcattaatatctccagaaacagaagaaaaaaattatatacttataaagaacaggatgcttcaaaatgaatattcaaaaaaaccttggaaatttaaataaagtagaaaaagaaataaaatgctcaaaaaaagacttgagagataaaggaatttcttcctgtgactactgcaaaaccagaactcaaagcaaaataaaacaaaaaacagaaatggaagctaagaaaaaataagaaaatcagaagaccagctcaaagtccaggagtttcagaaagacattccagagaagtgaaggggaggaattcattagcaaaaataatttaagattattctccaaaacagaaagatgtgattttctggaatgaaaggatgctgcaaagtcattaaaaattgatctactaccaaggctcatcatgatatttcagagtactggggataaagagaagatcacataagcttccaggggaggggaaaaccatgttatttaaaaggaaaataaattagaccagcttcagagttcataaaagtaacattgaaaactataaaacaatggagcaatatcttctacattcaaagggaaaataatttccaacctagaaatctatactcagccaaacagtcaataaaatccaaggaaagtctcaaaacgtttactcccatgtacccttccttgggaagctactgaggatacactttattaaaacaagttagtgaaccaagaaaaagggagagattggatcgaggaaacaggagatccaactcaggagacaagcaagctccctttgtttgatggtgaaaggaaatctttgaatgagaattatcagacataaaggggaatcactggagtgtaaatcaggttataatttcagagagagagatgtcttcaaaaacacaaagttgatagaatagttaaggtaaagaaatgtattgagaaggtatttagcgatatagggaagaacttgaagctgacttagggataagtacataaaaagttaagcaaataggggaaaaccagaaacaattgttagctccagggtaagtaggatattgagcagggaagaattttaatcataatttatattatggttcatttttgaattatatacatagatttgataaaatactgaataatcaaaattttgatttaactctatactaggaaggaatggggtatggggagtgaacatttacttggagagcaaaaagaactaaactcttaccttgtgtagttaatacataacacctaaaactgaaaagaaatctagaaatagcagtatgatcatgtttttggggtaaataccaagactcagctaagagttgaaactgattactttgtggaaggagaaatggaaaatgggggtgtcttgagattcctgtttgtattaacaagtcatagaagtagcttactcttgaactatgtgcatgtatcactttgataagaaacaaacatttaaaaaaaattgtcctcagttctagaattttcaacccctagaaatttctattcactctggtgtaaaccttgagaacctcccaaatatgtgatgagatcgtggatctcataagctctttgctctagggtagtttcaagcatggcttacatctgacatagccgacctcctggtgaatgatagacaagtgagaatatccaggtaatattcgcccttagaaacgtggagagtaactaaattttgttacgttggggatagagacaagaggagagtggttccaccatcagctagcttgttagcagaattttcatgtttgaagcagaaatattaacagaaaaaaaaatgcaccattaggtacgtgagtgatatggtctgaatgtatgtgtgcccccccaaattcatatgttaagacataacccccaaggtcatggtagtaaaaggtggggcctttggaagatgattaggtcatgatgctaaagctctcatgaatgtgattagtaactttataaaggggcttgaaggagcctgtttgcccctcctaccatgtgaggacccatggaaagttccatctttggagaagagaacaggccctcagcagacatcaaacctggtggcacctggatcttagatctcagacttcccagactccagaactgtgagaaataattttctgttatttaaaagttacccagtctaagatattttgttacagcggcctgaatggactaagatagtgggaaaagtaaagatgataagaacagctaagttcagagcagattcatttattggatcacaaaggaagatcttattcttgttttggacccataattaatttcaaggggaagtttgctgctttatataaaatgggaaattctgaaaatacttctagatgaggcactatggcaatattactcattcagaaaggttgaactttttaaggagctttttcttctttgattttatgttatttataaaggatttaaggtaccttttagtgtttcatgttctttgtttggaattctggacgtgatttcctgtggaaacacttgcaggtgtttgggtctacaatgccaaccctctaatgactcattcatctctggttgccacaacagcactgaactaatttttctatggaaaaattcaaatatgccttcatatagggcagtcaggaatacttgtgaccttattttgtaatggaaattaaaaaggactgatgataggtgggatcaggagtagagatgctctttaagggcaggagagtattactattgggaaaggtacagcttatagcagtgaagatttacaattcttcttccagtacctcttggcagaaaatactgtggtatccagaccccattctgaatctgatttgatttatttcttgggctagaagagaataaacatgtagttaggagcatttctaggcagtaataggttgaagagacaggtagagtggaatctcaagaggagagagggaaggaaggagatttcttcggtcacataatattctagttctggctcaagatattttatttacatatatatgtatatcttctgagttggatgcatgcacacatatgttgagctcgtataaatcaaaagctgtctgtacatcattttggtatcttgtcaacctcacaaaaactagtatcaatgaatgttatgaaatttcacaattcattagagaaaaatgaagtttaaatggtaagaatataaactcttaagttaatatgcttaataattaagaacttttgccttggagtagatgaagaaacccaagaattatatattaatttaacgaagagaaaaatatctatttaaagaattgaccattttctaaaattccagarcaacagtgcacataattggatgctcataacaacacagaaaaggatgctcagtctgtgaagttcagtctcaaccagttttgcattttatcttcatctttaatatcaggatagatattataacttaatgctttggtattttcctcaatatttcctttgggagactgaattttttcatagataaaagggaggtatacagatacgttcaatcctatttaccagaatgagtttttggctcatctttcatattgttttactgactgctatgaagaattgtcctcctcctcttttatttcatagaacatttctttttctttcttctctttttcttcttctcctttttctccttctcccctccccctccttctttttctccttctcctccttattctcctcctcctccccctcctacaacttcttttccttcctcctcctcttcttcttccccttccccttcctcctcctcctcctcctcctcttcttctttcttctgaaatggcgtcactcggttgcccaggctgcagtgccttagcacaatcatagctcactgcagcctcaagctcttaaggctcaagggatcctcccacctcagcctcctgagtagctgggaccacaggtgtgcaccactgtgtctggctcctattacacagaacattttacttggttttctcactgattttgtgatgttgtcctaattmcatagcgctggcacaaagattatataagcagtagggtactttgtggactcacgtgtggccaggtttgtcccaggatcttcaccctttcactcccttacttgtgactcaccccagcctatacagtgggaagaaattgaggtggagttgaagggattcatagaggtaatgaccccttggattgctggggagggctgtggcaacatcctccacccaccgccacctcaggtaaaggaagcagaggtgagaggaggctcttctaacacgtcctttaagccaaccaaggagttggctgcaaggatactactaggagacagtgagggaacatagaataagaggaaactggccttcttgtccccagctggagacttttggaagtacagaagccctttgcctttcctggggctgccagggagtacagaatcgggagtgaaactgatcctgagcgagtgcacagtgctccttgatgattactcctccgcaaattcagagactggcgcttactgcttatctggggaattctgaaggcaagggggcagctggaacagccataacgacagcaaaatgagggggtgtccgagagtagcctrctttttttaatcctgtggcatggaaaggatgtgtgactttcccacagatgaagaggatgctgtgaaaggtaaaagctcccttaaaagtttcttgcttcaaaggtggcttgctaaggcaagagaacaccctagtagtaggttgggatgggaggagatatatcattaagaataggtaagggagaatgtcaagaggcgagcacaagcgtgtgcttgccaagcttctaaagaaacttcctgtgtaccccactgaagtgctaggatttggatgtctgaccaacccagaggtcactgatggccagccagtattaaccaagggagggctaaaatgcagagtaattgaagccaacaacaaaacatgcacctttcctttagtcttctcttcctctgttctgaccttagagaaaccagaagagtggggtaaggataggaaggaaaagagaaggaacagtccagtttcttctccaccactgcagccctgagttaggggagtagaagagaagctttgaattggatatgaaattaaattttgatttagactggaccagatacctttaatccctgcatggrtgccatcattgatggaatggggcttctttgtatacctgagagaatggggcagctatgggatctgcctgagacaaggactgagagatgcatatccaacaaagcatgcttaaaagcagtgattggagagaagtaaagccatttcctgctaagttcagactgttcagtcaattgattatactgagagagattatgcagtaaagttatttagctgackggtaaagagtctctttggggatggtgtgcccagcgcacaaggttaaggagttggaagatttcttctgtgaataaaatcaatgtttggggctcagtctatcgggaatgacttattactagtactaaaatttgtgtgtgtgagatttaataagtctttaatatggtcttcatttgttgcttcatttattcaaacatttattaattgcctctgtcttacacatagaaaaaaacctaatgctaaggctgttgtcactgcgctcaaggagaagaggaaaataacagtaatttatacctgctagtatgtgctaggaactattttaagtgtgttatgcacacaaatctaatgtaattaatccaaaaggtagttgcttttataattgtttaataatgaataaaactgtattgcaaaaaggttaagtaatttgcctaagattatgtagctagtaagagttgaggctggaatttgagcccaggaactcatgctatgctgcttctcataatataaggtatttcctctaatacagaatttaatttagactgtgactaagtttaaagacaagattacaaggagaaggattaatgtgacctgaaaacattggataagacttcagactcatatgttccaatgctcctggaaggccaaccataaatggaaggtgtatytttaggacctggaatgaaagggcacggtagtatcatttcagagtttcagctgtttgtaatatttattataatatcttttttggtcttatcacccagagacatgttctttgcaataaaatagacagcttaatagatttctttaatattatttggagcagacatcataatttcatttagactttaagccttaggagatatctatatatgtatctataacatctgtatctatattatctaacaacgtctgtatctatttgtatttatatctgataatattggtgggtcatttgtagagttgtccttgaattctggaacaaatctcttctgatgcattctgtaaaatatgaggaaaaagcctttaactctttcatatcccaatttgggccaagggaagtcatagctatagaaaaatgacaccctcaataaacaggaacaattagaaggctattgcttgttgtattttgggaacagctttcgaatgctggctttgtggcacctcttaccccagaataatgtggtattatcttatatatgaagaatttagcattctagctgctgagaactcaacatttctaagatgctgagattatgtatcctatcacttccagaaacagtttttggaagaaagagagtctaggcctacagcttcttaggaaggcttaacacagggtttttagttgtgctattgtggctcctaggcaaagtgcagaaatgagagagccagtacctgagtcctaaacctccttctgacaacaatcctcttcatgaccctgggaagggcaatcmactttccggaacctttttatcacatatgaaattaaggggtttggactagatatctaggattctttcctggtctaacatttgatgtatttctctatggttcaaagcataacctaatggggaagtttatgacattctaacatggcatactgggttaggagtggatgttaaaatatttatttataccactctttcatcagtaaatacagaaaaaactggtgtgaaacttaccagtagggcaagaagttgattacctctcttgttttgatctcttttattacatgtctttgttttgcaggcctctacacttcagtgccctccttgacctagtaataaactctcctccacactgaagccttcactgaaaacttcggaatagaagttggcataaagtatagtaattaygactttcgtggactgaygtgtatgttaaggacttcaaagcatcctactattcagatgtgtggactgtgctaaagtagaagaatctataaaaccaaaggaaaacaaaagtgacaaaactggaggagttttatttttatggagwcagatgggcaaagtaaggtaggttgaatgccacttcagttctaaaagtctatttattttctcttggtctgactggaagtgccatctatatagcccaacattttcaagagaaggatgacgatgaaggcttccatggcaaaataatgagaaaattgtcaaattgtcaaaaatcaagctttaggattcaacctttgacactcatgattcatgatatgctttctttactcagcagtggtgtgtgttactttaaatgtttagaaaacatacatgtgcatgtatctttatagcagcatgatttatagtcctttgggtatatacccagtaatgggatggctgggtcaaatggtatgtctagttctagatccctgaggaatcgccacrctgacttccacaatggttgaactastttacagtcccaccaacagtgtaaaagtgttcctatttctccacatcctctccagcacctgttgtttcctgactttttaatgattgccattctaactggtgtgagatggtatctcattgtggttttgatttggatttctctgatggccagtgatggtgagcattttttcatgtgtcttttggctgcataaatgtcttcttttgagaagtgtctgttcatatccttcacccactttttgatggggttgtttgtttttttcttgtaaatttgtttaagttgattgtagattctggatattagccctttgtcagatgagtaggttgcaaaaattttctcccattctgtaggttgcctgttcactctgatggtagtttcttttgctgtgcagatgtgcagaagctctttagtttaattmratcccatttgtcaattttggtttttgttgccattgcttttggtgttttagacatgaagtccttgcccatgcctatgtcctgaatggtaatgcctaggtttccttctagggtttttatggttttaggtctaacatttaagtctttaatccatcttgaattaatttttgtataaggtgtaaggaagggatccagtttcagctttctatatatggctagccagttttcccagcaccatttattaaatagggaatcctttccccattgcttgtttttctcaggtttgtcaaagacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcacaaggacaaaaaaccaaacaccrtatgttctcactcataggtgggaattgaacaatgagaacacatggacacaggaaggggaacatcacactctggggactgttgtggggtagggggaggggggagggatagcattaggagatatacgtaatgctaaatgatgagctaatgggtgcagcacaccagcatggcacatgtatacatatgaaactaacctgcacattgtgcacatgtaccctaaaacttaaagtataataataataataataataataataaatgtttagaaaaaaattctatcataaatatgaccatttaatttcctacaagtttttcaaaagtttcttcttgggtttattcatccctatggaaaattccttagagagatttargaatcttcagtgaatacttttagaacaaatggaaagaaagcaaaaatgctgtttcatcattgagaaaaataaaactcaaaacaagcttaaccatcaaacctcttctttattccaatttgtcatatttgtaatagcaacaataagctsttcttagaaataatgtgttcttagaaataaataaaatgcatgtttcttactgctaaatgccagtgtacaatgaaatttccaagccaattttttggggaaaaggtgtaacttctgtataatgtatttaggatcttaagtggcatatttctgttggatggtttatatgttatctatagatagcacctcactactaaggcataataaagaaacttgtgctcaaagaggagggataaaataaaaatagaatttgatttcaacaagtggatttgatcatttgcaaaatggtgataacaatcctttctctaactcacagcattgtcatattattagttaattataatgttaatagtactaatattcatcatctcagtgttcccaagagggtcccaaggaggtcatactaacttcacttcttatattttccagtttgttagcttacaagttgtaactgcagagtcttagcttcacattcaccttcccccaccatttctcctcaggtgtgccctagtgtgaactaaatctgtcactctttttctgttcttttccttaaggggtgctgccatgagaacgcagatcccctacttctctgaaaagtgcagtgacattcccactgctgtgttgttcccccttagtttcttcagacacatctacaattttccttcctcccagaactgggaaaagctctttttctttgcatggactttttcacctgagtttgaaagcaccgggcatggttgtgcctttaagtttcacaatgctcttcataaaagtggtctgaacttcagcatttctttttttttccctgagatggagacttgctctgtcactcaggctgcagtgcggtggcacgatctcagctcactgcaacctccgcctcctgggttgaagcaattctcctgtctcagactcctgagtagctgggattacaggcgcccaccacacccggctaatttttgtatttttagtagagatgaggtttcaccatgttggtcaggctggtcttgaattcctgacctcgtgatctgcccacctcggcctctcaaagtgctggtattacaggcgtgagccaccgtgcctggcctgaacttcagcttttacttgtagtctctctctctctgtgtgagaatgagcccttgttttgctaagccagcctggagaatacatcccattccaccctccatttttttttttatcatccttcttcctttgtttcttcctcaagtctctcttttctcctttacaaaacacacacacacacacacacacacacacacacacacacacggacaagagcaacaaaccaagtatatccacccacaaaaaaaccctccaaacatcattaattcatggaaatagatggggagagacaagactgtcggccccacaccagcaatcactgactcagtctaaacaaagagtaacataataatggtatacaacagagaatcaccgtttaaattttatgaccaggtctttaataagtatcttgcagcctgttatagaaaaacactttcaaatagtgtgatatgtctcataatgggaaaagcgtcccccrgaagtactgagcatccagcaataaaggcatttaagtagacatatcatatgatcaactttaagaggcagtttccaacatgtgttgtcttcattgccggattggaagaaacccgggggcaacgtatcatttatttagcrtaacattgtattttgcataatactagagtttctaaagaattttcatatatactaagctattttaatccttgcaagcaycctgtgaaataaagcaaggactctgcttatttaataaataaggaaagaggctcagcatgattcataaattttcctggagtttcaggactggcaaatagcagaattggagtgtgatgccagccaattatatccttaaactttacatatattgcccagtgtaaaagttcaagaatgcttatttctttgttatctggaaagggctgctgtaaaagcaaacctaagtgagactgtttgatcgtccatgcctgccccaaagttccaagaagttttgaatcacgtaaaaacaatcagaaaaccctgttggttttattcctttttttcctccatcccagctggactgaaatatgtaaaatctatgggatttcatgtcataccaactgtgcaaattagtggcacaatagattgtgagtttcttcagggcaggaacctttcatcttaatatttcccccttatgctgcatagtattgacttaaatacacacacacacacacacacacacacacacacacacttaaagaaatggatagatggagagatggatggataggtgggtaggtggaggtgaccagggaccctaaagtctgtgactcaaggatctaggcccagttcttaaagactcatattgcagctgattttttaagaatctccccaactttctcgctaccattcgacagagagagagacattctgctacattttttctcctgggtggcctataacggttcacattcaccagttcttgtaacttgtttttcactcaaacccagcttgctgttagtctgctgtgtctaaatagtcatggatcctgcacctgctctaagacaggctgttaagtgaggcttcctttcggagactgcaaattcaggactccaggcccctcagaatggttgtttcatgatttatagctggaggtgtgtacttctgtgtgctgttggtcaatgatgataaagtaggtatcagtgcctctgtgaattttctgttgccctttcataaccaccatttaggagcatttaatcaggaataaagtgctaggggtgggaaaaccatttcaggttgccattgcactgtggaggcaattgtggacttttcccccccatattttctaaactactaaaaatagtgtttcacatttacctgcataattttatgtctgctctttccctgcttgagcagataacatgatgacagcttctctgacccctaattttccttttattttcaactttgaccatggagacatgttaagccccaaggaagcactcatttttactatcaacaggtatagttgcccccttaactggtcataatgtctgctaaatagcatcaggccctagtaatccaggaggcaatccacattcccttactgaaacagagaaggggaagattcaagatggaggggatattgaatagttgaatgtcatgcctaagtattcttacacgtttacaggtttagtatgctgtggatattgatgcttataaatctcaagattttggcagttctcaaagtacagtctctatcaccagtagtatccgtatcacctgggaacttgctaaaaatgcaaatttgtatccacccccatccccaatctactgaaccagaaaatctggcggcagggccagcaatctgtgcatttgcacagatgattctgatgctcactaaaaattgagaaccactggttttaggaagtttacaaaagactgaacctttttctttctgtctttttaaaacattggtgtggacaaattaaattgtcccttttctgaacagcatttaatcatactgaacaattattcataccttttcttaagcatatgttaatcatattagaaatgccattcccttctcgtgcaaaagggcaaaatcagcaacatccttccaatgtgggtgggtaaatgaaggctctgatacaagaattgaaatgaaatatgtgtgcaaacagttcttagtactgagctgtttaaagaaggcctacctttgcacagaaaatgtctataagaattactcattaatgccacttaatagaggaagagtaggagataacgtgggaacagggtctttttaaaaaataccactttaaagaagaggcttatgcttcatcatagacaaaatgctttgtatagtactaacaggggcatatctattcctttaatgacactctaagccagtgctttaaaattttattgttgtttttattgcccctggaattccatttatctatgatagtgttggattaatgtgtggtaagcacattgccacatcagtccatgattaattagccgacatttattgagtacttaatatttgacccaaactggatcaaaactggggaatatagaaactgtcgtctctgctaacaagtttgcaatctagttggagagatgggagtaaaactcctgaaaaacttgggctcaataagataacatgatcaagagtgaggagacatgatatagactgcaaatgcagggaaagtgcactttgtggagtggtcactccagtgtttagtatgtcagaaaggaggcttcatggggcagacggatctcaaaggatgcctaagttcagcagtggattgtttgcagaaatggcctaattcttcccctgcttgtatctctgctctttggcattgcaacttttcaggtccttatgtgaagaggtagagtctactcctctgcccctggccttgtaatggtggcaatgttgacgtgctaattctgattctagacctcaagagacctcgcacatctccggccactctattgaaacacaaccagctgccatgaacaggcccaggttaagtctgctggaggaagagaccacattctttatgagatgagatgtttcagcagaagccatgggagactagatagcccccagcagagccatcaatgaggtcaacagaagaactccaccctagctgaacccagtccaaattgccaacttgcagaatcttgggctaaatgaaccaacaggtcaccaaatgttgaagtggtttgtcatatagtgacagataactgatacaaatctggaaggtagagaggaagaaagtgttctaggccagagttgtacctcccaaaaagtcgagtcagaaatatgggaggccaggctaaagaaaagtaaagaaattagtaggattggatgtttgaaccactttctttcagtaaatcgctagaagcacccatgcagggttcaagtgaacgtatactggaggccagacctgcccaactatgctgctaaatggtgatcttctcctgaagcgctccatcagggtatgagtaacagggaactccccttgccaagacacacagggagtgtgatgaccctgtccctccaaactgcactttgagagaatggaaccttgttttgtagccaactatattatgccaagaacaaaaagatctttgtagcttatcatctgtttttatgttttatataaaaatctaaagcttctatgacatactttcaagaaactgctagaggcaacacgtagaatcccagagtaaagatattatgaagttagagtactttaaaattcttcagttctcacagtgtggatctatcgcccattgaataacaactttaactgttttatgaggtcactgaatatatttttcactataaaagaacatgagagaaaatatttaccttgaaatgctaaaaatgtgttccctttctgtggaatggcatttgttgaaaggaatatcccgggagaggatggattcttgttttagacatagctctttaaatttggcaggacatgtgggggtagggggacagatgggggtggagttgggggagcttggtattcaggtggcacaataccaggtggaggttaaatacctacaactccttatgcctgggatcttttgttccaatagccatagaagcttctttcatttcactttttatttttattttttgcaaaacccattagttgacaaagtgccataaactttgtacaaaatggcctcgttcagcaaatattttattcaaactatgctcctatcagcagtaccacacatgtcataaagtcatggtgaagcaggaatttcagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacaggtaaacaggctggcgaggcgcaggacgctgtcgccgccgcggccacccagcgatttccaggcacgcaactccgcctccagggctctctccctcgcgctctctcccagccgcttgctcgcagccccagcagccgccgcagcatcacttcacacaaaggactgtcacccgcggagcagctcctccacctccacgtcctcctccggtgacagcagccccgacagcagggctcgggcgcggcggcggcgcggggggtggggggacctgtcactccctgtaactgaggcggcggcagcggtttttttgccttttctattttgccttttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccttgggggcgcgaacccgcggcgaggagggcgcatcccgggcgcgcgggcagcggggctcgacggccgcccgagcaaggcagaggcgctctgggtcccagttgttggtttcagggtggtgggttctcagcgatcctcagagagggaggtttcgctttctccagcttcccttgtcttaggctttgccactggagaaagcccaagtttagtcctgggttggggcctcctgaaactttttaatcctttggggtttggctcaccaagtagatcggaaatgtgccggctgctttcttgtgggtgatatgaacttggctttggttaggagttgctgattctgggcctcctttgaaggaggaagggtgagtcccgcaggattttaacgccttcccttcacttggagtccagagtgtggagatggttaggggtttgcttctgtgtctgtgaagtctctgcaaggaaggggcagtgcactgacattccccgacagatgtggcagagttttttggcaactcaatgtccagcagagaggtgcagtctgtaccttgtgaatatgtgtaatatgtgagaattataaagttgttattggtgggggtttttttttttggccaagtcatctcaagaaattttgttttcacaatattttggtttggaggatgtttttgcacttcactgcatcagaacagatgaacgaaattatggaatatcacatgtaggccctgaagaagaagaattttggaagtttagcaattatttgctacaccttttcccacttaccactgaaaagtattcttcccgggtctgcttcatatgatcaggtttgagaaattagctgattatctcatttcgttgctgaggtagcattatgtttatgccattcataaactaatttctatgatctaaatatctgtataatttcctgattactatataatcactaacacatagcggggtttcttctcaaacagtaaattaacacgattacacatcacaaattccaacatgcataatagcttttccccctggtctttatgtatccgtctaatagacgtttgggttaattgaatttttataaaactcagcaccatgccaagcagagtctgcctgtgatggagagtgtgtcagttcttttaaatttgtgtctggtgggggccaattatttaaatttctggttggcatttgtggtggttaagtcctgctgttaattaatacctgatgatttggttttaatgacagcaaagatcattgttcacccaccattcccttatctgaacaatgtactttgtatgccagagacctgttaggattgcaccactcagtggacagaagctgttcagagagtggtgctgaagaaagctaagtggcatagggattccccgagacccactgatagatgtcactccaaagcatgggaaatgctctgctgggagctgtcttattaggcaaccgaaaagctcagcaccatcgtactgcagcatatgttactctgttacagaatctgaaacaaaaccttttaagcaacaccactgtccagttttcatatgttttatagtgtgtaattcaggaaggatttttcctttatcccaagtcatgagttttgaatcattcacaccacatggtgggaagttaatataaaggggattgtagttagctgtgatgcctaggattgggggtgcattactacattatcaattgtgttagttataccttttaactagaaataaatgtaagacttgagaggtaaagttcttacaagcatccagagaatgtttggaaatggaaaactcatgttgtttggaggaatcatattctattcttgtgcttctaaggggaaaaaacttcattgaaggtacttagttttgtccctcagtttgccagtcaaaagaaatataatacatagttgtaagttgtggcacgttttaaaaaaatgggtttttaatgagctggagatctttttgcatgtaatcgagtatgttaagaaatcacaaagttactgccctggatttctgtagctattgtgtgtgcttggcgatttttgtgttatatgatttaaagtaggatattgcttttaacctcaaatagatttagctaagttctaactgaaatcatgctaaaagtttctcctcgcatttttacaaacatagtgtttcttgtaaaactggaggataaaagcaaataatatcagctattttatatgatgtaaattcagtaaatctgcacttggaatattgagtgtaaaagtgtgtgtgtgtgtgtgtgtgagagagagaatgaatgaatgtgtgaattcatccagttgtgtggtgtcagataatgccattcagaatttgccaggcaaagaaacacagaaaaatggaaaagagagagagagagagaactagcaagaggaaagaatgagaatgagaatgggggctgatttgttctggttgagctgcttctggtcagaagatttcagggagagtgatggagcagaaggccctcacctaacatgaagctgccctgggggcgtgatggttgtgtgcaggcttgagccataatgctaggctggagaaggaatagagcaaagtcattttgtgatatcatacccaggggaacagtttccagctctgctgctctcagctgctgtgttgtttcctacaagttgtttgctagtgtagaaactacacatgcaacagattagccttagggttgagttaataaaaatctttcctcttgaaattcctttttctctttccccctcatctaatataaactccggaataatgtcgataaaacaagaagctctttgaaaaatggacctttggaaacagaaactatgagtgtattttagaagacaacatggaaattcatagcttaattgctttgtagttgaagtttgtataaatgacacttcctttacagttatttaaagtgtttgtagtcttcactttttctgttgctcactgaacgacctaagaaatatccttgggttttatgttcattggaatgcaggataatttgctgtccgattaaatctctattattcaaacaagtcattgtttgatgtgctacacttttagcttccaaagcattgtggttatatgaggcagaagctgatttccaaaaaggagtacaaacactgaggttgaataacatctacaattgggctatgccagatttgtacatcaattctgatcttacaagccaatataagtattttatatcatatgatggtagaatgaagatgtatacatgtatgcatgtattgataatgtaaacatctttatcaaatatttatgatacatagcacttgctctttttaatatcttcagtcactatttaataaagtgtgctaaccttatggtgttttgaaaatgaaagaaaatgctgcagagattttccagtcagcattaaagaaaactattcttaataaaagctatattaaggaaatagaaacagtaacagatatagcctgactgcttgtatgttgtaaatacacatgtaaatttaatttcccaagtgtttgtgactgctctttttaaactttataaatcttgctgtcaaaaatctataccggatttaaaatagctacttctactgagtagagaaactatgtatttatttatatgtatgttaaaaatgaaaccaacataggtcatttgggagaagaactccttagaataaaaatattttaaaaagtggatttaaatatctgagttagaatatttcactagcactaggggatcgttcttgttgttgtggggtatctataaatcctctgaatgtaggraaagtcttaccatatgtcctgatgtattaagtaagactaggagctttagacaacagagaattaaaacagtgagctgtacttcctctggcttgtatatttatagcaaatgagagcaaaagatgtgattgggcgggttattgcccttgtcaaatataatctattcattcttccggaaatctcctttgcttcgatacctattttcttcctgtttttttttcttaattataaacataatgtcttttacaaccctcttgtacatttcaatgacaatttatgaactgcttagatatccaaagatctctaaatcctcatagcaatacttagccttttatttgttttaaatatggttgaatgatctgaaaaaataatctcttttgatagctcttaatgaatgggtattttgattagctttgtatagataaatgataatgaaaacaaaaagtatacaattagggttcttactgattcaagcaatttgttaccaccccaaaatagtgcaacatggcttagtgaaagtcttcataagaaagtaaaaactaatttacaatgttcttatttcctaatcacagaaatgggcattgtggacagttttcaaccaatatatgaatactctaaatttgtgcatacatattgttactccgcttttatgttataacatgtaagttaaaattactattatgaaagaatatataacctggctagtttacccccaacctctccagaatatcagtcgctttatagtacttgaacgtttgcttagtgacacattctgttgaaatctaatgttgaattatttgtggatttacagaatatacaaattcacaaataattgtatgactaagacaaaacttggtcattttaagttgagggattgtcctagttgagaggttgtgttttcatattgcctaagttgttgagtgctgtagtgcacttcaagtaaatctgtttctgaagacttgccccctggattttcgtccctaaattatccatacaggttgaagcagataaaatacaagaaattttggtgaagttgaaggttaaaaatagattgactagtctcttcttggcatagatacaattattaggaaacagttctccctaatacagacttgccatccaggcatcctagagagagatgcatatgtggtaatttacattaatttttggtcttcttcaggagaaccaggatatttttccctacggaaaatagtttgttaggaagttctttcctggcccttgatttacctcatttggacctagtaaaatttatactttgttttaaattacaactaaaaaatcaaaaagaagaaatgttacctacagtctggatggaccgtaagagactgtcctactactttctaactcagacttctgtgttttttcttttcttcttctttatttcccctatgaagatactacaggggaagccttgggtaaatgatggggcccaggagtggattgtagtgtatgagtttaggattgctagtcattatcatatggactagccttctctcgaaaccttgaaattcagctgtccgggtccaaggaatgttggaaaatagaggtcttagatcacaagactgtgaatgcaaatggtctttctgtttctgatggagtctttgtccatcccatgaggacgtggatggtaacctgcattgcatctctagttcagaggctttctctccaaagcccaaggctctgtctttggacatctgccctggcttgctgggaacaagaaaacagctctgagtggtgcatgaatccggagctagtagccaggtttatgaggtagcaatggtccaagggaacctagaggagggaattgtttccttttcttttgctctgctgtgctagaatatgtgagctgaatcaagcccagtgcaagggaacatacctgatgagggcactagagtcttggtactgggtatacctaagagcccaggggatggacgagggataagaaatgtgaagtactgtcagcttcactaaatttggaaaatgcataccagtaatactatcatcccaaatggttgtcttttatctgggaattgccattaaggcaaagatagctaaaaaaattgagggcatactaaaaccacatagttataactaccacttatggagttggtaaatttttttggcctctttgatagacacatagagtttgatttttatgtgtagattaaattcctgttgaataattaatgaataaatgactgaaggaccccagctggttggatagtggaaatcactgttctagcctaaatttagaaagataaaaacatacttttgatttttttctcttctcatctctgatatggtgagtttgataccaggacactgttcccttctcttcccatccagagccttactgtaatctggatcgacctttggggcttcagagaaaggttgtttaatttcccaaaacttttccctcacttatttttagaacaatatttgttctgtgtagcttatagcccagcaggaaaaaaaaattccagtgttgtaaatgcttaaaagtacagaagagttttgctgtagtctatgaacccttaccactgttttcagcagaaccatttgtaaaccatcccagtttattttgggtgacagacttcagtattcagaaattttgtgttctccttggatctctcttcacaggtgtttaaccatctcagtactgtaagtgatactttatgttgaaattcattctcataactgaagatggaaaaacacagcttatatccctaagaagtaatacaaagaggttttagatcagttcctctttacttatttttcttgtttccaatatcacaacagctcttggtttacctgcaggtggggtggcatgtgcccatttgggctctgatgaataatgaggttctttgccttcacttcctcagtcggccctggaggcactgtgggagatgatgtgttatcagtgaagcagcagatgtggtggcagcattttcctccactgcagggagcatcccgtctgtacctctgtacagagcaggggagctgtctactgagaaggaaatggatggctgtgtttgcttcacatagaatttctcattagccttgggaagtggttctggcagttggggccccttggtggttgccaggatggagaggttctgctcagagtgggtgtgctcattgtcctgtcatctgcacaaagggccacagcattgagataacctaggcatgctgctgctttgcaagcccggacacctccggacaatcctttcctctgttgtcttcattcccatccatagagatgggtcacatcttgtcctcaggaacactagcacctttctttttgttggagcagaaattttataaaacaccctagcattttggaatatagttttattccgatgagcagtttagaaaaatttatggtaacataaaatttaccattttaaccatttttaggtgtgcagttcagtggcattaagtatttgcattgttgtgtaaccctcactgcaatccatctccagatattttatcttcccaaagtggaaactctgtattcattaaacactaactccccattccctttcctccttttccccaatcaccattctactttctgtctttacaaatttgactaccctttttttttttttttttttttttttttgagacggagtttcgctctgtcgcccaggctggagtgctgtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctagatctcctgaccttgtgatccgcccgtctcggcctcccaaagtgctgggattacaggcgtgagccaccgcgcccggccctacctttcttaagtgtagagttcagcagtattcaatacattcgtaatgttgtacaactatcaccatcatccatcgccatactcttgaccttgtaaaaccaagactctataccaattaaattacaacttctcattttctcctcccccagccactgacaaacactattctactgtttgcctctctgatttttactaagtgcatcatttaagtggaatcatatggtatttgtccttttgtgactggcttatttcacttaccataatgtcctcaaggttcatcatgttgtagcatatgtcagaatttccttcttttgaaaggctcaataattttccattgtatgtaaataacacattttgtttattcatccatccatccatcagtggacacctggtttactttcacattttggctattataaataatgctgctgtgaaatgtcttctcaaatccctgctttcaattttttgggtatatacacagaagcagaattgctgaaacatatggtaattcttttttctttttttcttttcttttttttttttttgagatggcatctcactgtgtcgcccaggctggagtgcagtggcacgatcttggctcactgcaacctccacctcctgagttcaagtgattctcctgcctcagcctcctgaatagctgggagtacaggtgcatgccaccatgcctaagttttgtatttttagtaaaaatggggtttcaccatgttggccaggcaggtcttgaactcctgacctcaggtgatccgcctgcctcggcctcccaaaatgctggattacaggagtgagccatggtgcccggcctcatatggtagttctaggtttgctttttggaggagctatcatactgttttccatagcagctgcaccattttacattcccaccagcagtaaacaagggttccagtttttccacatcctccctcacacatgctattttctactgttttgatactagccttcctaatgcacgtggagtagtggtgagcagtttttatattgttgttgttttctatacagagttagtgtctctaattacactgtcattaacaagaagcaaaagttctcagaaaagagaggtgttcatttattcaactcttagtttaaatagcatgtaagatcctgaatctgaaaccatgaaataaggaaattacaatggataacagcttaataaaaacaatgatttaaagagtaagcttagaaataaagaattgagtaagcttcgatttaaagaataagcttagaaataaaaacaatgaaagatgtaaagaataagcttagagaatggacttacagaaaacagtcctccaaggtcatcatgagaatattgtatttttattcatattgctatcagtgtagtccagaaaggaaccttatcatactttgattagtttcagaaccttttaattgatttaatgtattcattaattgcctctaccccagcaatttccctgtctgtattcctgtccattgccccaatccccttctaatcagtacgcaccagaggctgagtcattctaaaatactacttttttttttgtttgtttcagacagggtcttgctctgtcatccaggcgggagtgcagtgggacgatcttggctcactgcagcctcaacctcatggactcaagcagtcctccacttcagcctcccaagtagctggtatcacaggcccatgccactatgcccagctaatttttgtattttttgtagagatggggttttgccatgttgcccaggctggtcttgaactcctaagctcaagcaatgctcccacctcagcctcccaaagtgctgggattacaagcatgagccactgcacttggcctgaaatgctacttttcttaggccttgttccctacttagaaagtttcaatggatgcaccatagttaactcaagatctcaacattcaatatcctccttagcctcaataaagccttatctttctcaccttcccatatgaacacttcatccactctgactgctccctgaacaggccaggcactttcctaaccctcctgtttttacatatgccatttcctctgcctcgatcttcttccaccctcatttctacctgtggaatttctgttcttccttctagggacagctcaaatcctactgcttccataatgaaactagtaatgattcctaccagggatatgcactctagaatttgaacacagagctcctctttcctgtgtaccttacacaaggtactgttacaaattttccttctgtcatattgtgtttgttacaatgtatgtattttaaaatttttctctgtttctgtgtgtcttgcctcactggcagccaacactattcttgtgtttggatactagcagggtcttcagcttacttgccagtgaaaagtgccctggcctcgagtcagaagaatcctttccactttcagctttgtagttagtacctgtgtgattgtgggtcgctgactttattcactcatttgggtctcagtttcctaatatgcaaaacgagaaggtaaaatgcttttcaaggtccgtttaaactgtatttggtcctcagaaatgacccaaacatagaaatctccttcttctggagctttttctggagcttattttctcttcctctcctcttatttagtgttgttctcaggagaacacatgtgggaaaacaactgtgaaacttttagacactctaagagaggagaaagagagctgaatgagagggaaccttcaagggaaggtgtctcttttctccaaatcttatctccatggcctttttgtgtcatttaaaaaaatattaacagttatttgcattcgctggcatcgtcttttcaaaaagcaaatatgattgcctctgcaagcctgtctttgaaatgataaagtatgattaatccacagctgtattctttagaatgagaaagttcagtcatttgtggtgctaaaatgaaaaaataaagatttgaatggttttactatttactgtgaatttatttttacaatgtagatggggcattgttttaggttctaataattagcactgttgctgaaatggatgaggtcagcacagagagtgtggagagcttggttttcaggggggtggcagcagttctaatggctgcagggcgaggcttcctgctgagatgccagtgttgggttctttctcaaattatgatttttatggtttgggcaagaaaaggatgcatttaagctcttttataagtaaaatgagcaatgctgaaacagttgtcaaatgggaataatttgatctgacttttacaatttctgcatgaagaggtattggcagctccatggcattggggcaggatgggcagggcttagctgggctaggtccattttttttttccttcagtttaacgtctccgacccctggtggattcacctactgcagaagagccaatgctgcttataaattatgtttcctcaatctatatctctagcccagacctttctttttggctctctatctgaacatctaactacttacctggtaacttatgtcctacaaacactttatgtgaaatattttaaccagtgcctcatctccactgccagtccctctgcacatttgtatcctaataatgactctaccctcactgctagtatgatcaccacagttattcccagtgacttccttggtcgacacttatttggtgccagagtagtaggcgctgagataaattcagttaacccctcaccatatggcagcattaatattttttagttacctcaaaccagatacctctcctgctccataccagattagtgaccacatcccactgattctacgtccttaacaaatctcagattcgtcccgtcttccctcacttcaacttctctgtaatagattcttactgcaactgtaacagcctctttatgcatggattctttccttctcacatccattttctatactgttgctagagtggtctttctaaaatagaatagatggtactgtgcttttacctaaagcttttcggttgacatcaggataaaactcagacccctttgaatggcatgtgagggcttttggcttttgtcccaagtgttcttgtccagttctttctcctatccagaaccttgtgctacactgatggcattctctacatatgccaggcagctttagggctctgtggatttgcacatattgttctcttttcccagaatggtctgcttctctatctacctgtttgttgtactgtcactacctgtcatttcagattgactgtccttccgtggaatggttaaataacactggatagccctataacggattgtgctatagtctttacaaatcttcttgtaggagaaaatatgatgacttagagatatgtttatattacattgtcaagtgaaaagtgttgtataatacatgtgtgattgacttttctttctttgcttttccttttcttttctctttctctctctctgtgtctccctttcctttcttccctctttctccctcccttcctccctccctccctccttcccttccttcctctcttctctcctctcctctcctctcctctcctctcctctcctctcctctcctctcctcccctcccctcccctccccttctctcccctcccctcctctcctctcctcttgtcttcccattgatctttcaataaaaataaaagcctagaactctatgtagctaaacgttaacagtgtttatctctgggtattgggattattgatctttagaatgatcttcattttgtattttctaaagtttctataatgaatgcacattactttttaacaagaagtagtaaatgctattttcaacaaaaaatactgacttgtggcaagtactatgtcttacttatctttgtctttttagaacattgccttcctcatggaagatgtattagttagggtaggctaactgcagtaaccgatgatacccttaatatataacaagtaaaatgcgatagtttatttctacctagtgaatgaacagaacacaagatgttctggtcctgactttcccctgaataaaatctgcactaactaacaccgaggcatagccaaacctcacctccagaccaaattggctgaaataggcagggttccaatttgtgacggtcatttatttttaatggcctttctattccctgaaatgtagacaaatttgccctttgctgcctcattgcagtggaagagcctcatacctgtgtgcagagctgatgatgaaaggcatctatgtgtgtatgtgtgttgtagataaatagtgtattaactatgtgtaattccttatttcaaagtagcattttatgggtgagttttgcaataaatcttcaacgtttaatgctcactatgtcttgtttcatttgatatcactgaaaatgcagagggtcaggccacattcactctgtctctccctggcatgttaggttgccttctagagctctgtgtttcacaaatcattttgatgtagagactgtggagaaatattctcaggctttatcactgctgacttaattgagtttcatgatgcgcttttttttttttcatagtaggataaattaaaaatggctgataaagctgcctgtaaaagcaaaattgttaggttaaacctgcctggtgtattaaatgtattgataagtaatttggccaccatttttaatcacttttattaactctcaagtagttttatttccagtaacttgcaaaataactgtcattatggactcagtcatatttctctttaaaatactattgaaaagtccatgaaaatgattaaagtgccaatatcatccacctacttcctgttagcaagaattgttggtgattttgtgattagctgagtatatggttgtgctctctttgtgcaacccaggaggaaatagaaccagttcatcccaggtgaatagagataatgaatgggtttgaagccgtgtaacaggagtagtcttttgtgcatctgtatcatgtatgttattgttatgctgtctttaaaacattttattaaatattgagaagacaagatacttgtgaattatgtgtaaagtgtaaagaatcatgatacgtgtaatgtgcctttcggtgtcatctttgccatcggctgttcggctttgtaaggatcttgagttcaaggtcactaaagaacagcttaacacattgtcttgctcacaggtcaataagggatatatctcttcattaaaatggatgagaagtttgtcattactttactgcttcttggctagatgtgtggcttatgcctgtaatcacagtgctttgggaggttgaagcaggagaatcgcctgaggccaggagtctgagaccagcttgggaaacatagtgaggccctgtctgtgcagaaacaaaaaattaaatttgccaggcttggtggtgtgcaccttcagtcctagctactctggaagctgagtcaggaggatcccttgagcccaggaatttgaggttacagagagctatgattgcatcactgcactctagcctgggtaacagaataagacctgtctttaaaaataaaaaataaaaaagaattccctgtattttttccaatccatttgcatagcctccaaatcccattcctttcccctcagatttcggcattcccaccctatgggagaaattattatagttgccattcttaggatgtttcccagataaattacaggaatcataagattgctaaacaaatgtaggtggctaatagaaaaagagaagcagtaagcctacttttttcatttacttattcagcaaatgtttatcaggcatctattatttgataggctttgtactgatttctggcttgacaatgatgaagaaattagacatgcccctttctgagctaagaagataggcaaaagggttacacaaataattatataattacagttgtgctaagcctcatgagggaaaagtacaaggtcccagccaggtgaacatataacagaagaatctatcttagtctgaaagatacaagaaggtctttttgagaaagaagcatttctgttagggtagggaggaggggaaaggaggagaggaaagatttgcatttccaaccttggggcagagaaggtgaggaatagcagaaaggacagtcagcacaaaggaagcaaaaatggggtctgagaagtaaggaacaatcagacgattctagacttccaggattccagattttatcttaaaaacaggggaacccaatgaagggtttttaagaagaggagttatatgcttgtcatttcaaaaacatcacaactgctggttataaggagaatggactaaaagggaataagagtgcatgcagggagctgaggtggggccccagttgagactggatgtgtgcctggactagagtgggagctacagaagtgaagagaagtgaaagatttgagatgatttttggaagcttcttttagccttggctgtgatggggcaatgcctacaaagggcggtggggaggatggcccccagtgttctggcttgagcaaattgtatgcacagtaggtgatgcgatggcaaatactgcaggagaagaagcccttgtttagtgtattgtcgacatatccacatggaaataccaaggaagcatgtgcttgtttggagctggaggtcagaagagaattccaggttgtcttttgagtgtggtggttttggacaaggacatgacatttctagctccatgaagtagataagattgcttagggaaggtgggagagtgtaaggaaaagtgaagagaaaaggaagcataaggaacagccacctttaaaggtgaggcagagtgatgggaaagaagcaattagagcagtgaaaggaagacccaaaaaggattcaggagggaagagtggctgctgcatctgtgtccctcgaacatcctgatggaagaggaggaagacagagcccaaaccaggactttttgagtggtgactattgccacacattttaaatgtaagagtgcacattgcatttaggaccagtgaggacttaggacagagttctggccaatgccagaggtggagcccagaccaggagcagactgaagtactatttgccaacttccggttaagattgggttttagtaatatttttatttatctggacataagtagcacaaagctgttttaaatactctgaggctttctttggtggtgggggataagactgggaagaataactaatttgagagacccaatggatagtttgtataaagatatgattttcaaaaaatcatcaaaattgattaagtgttactaacgtgttgctgaaggtcactcgtttatgtgtttttctcctgagctaagaattctttcctatgtaccacctaagccctttcagtgacaaattattgttcaaatttttcttggcacactgacttgagaattaactaccattcatagctggtacccaggtcctatgagaatacaatgccttgtcacataaatacttgtgaagtgacatctatcaatctaatttagaaaaatatttgagtcaaaaggtccttgaaccatgtattaggttgacacaggagctccctttatctgaagctgtgactgagcattttaatgaatggcagtcaaggaattcaaagttattattctgatagtaattgcgtgcatttttcctgcccatctatatgcagccttctcattgtctaggaagctgctgatttgatgcattcatagctattatttgcatagggaatttgaaccaccatgggaagaatgattttgaatttcctgttttcatttatttactttgggtgcaataacagtgttttcatggaaggattttttatattgggtttttcctaattttaatacagtgtaaataagctaagtgttatatttctgaaaaccacacgttacaaatttttaaaaatgggggaaagatgaaaatgaaataaaaagatgggaagacaagttctgaaacctctgaccttacctgcgggctcctccctctagttgaccatggagaaccatagatgacttactgggccagatattctgatcttggacagaccaatggtttgtaaaatgggttgcatattatagtgtgcaaattcctggactagacttccagagatgatagttcatgtggcccagggtttgtcctgagaatctgcatttttgaaaagctctccaggtgatttttagtgtgcacttaagtctgggagctcttggaattgtttttttcaactaataaagttgaagacaccctgcacaagattagaagatggataagaaaagagaattagaatttactgagtttctattatggctgaacatgtttacatatcttacgtcatttattctttaacaccatcttgcaaggtatatcattttgttccaattttaacctgagattcaaaaaggtttacagaactttaaaggtcatgcagctgctgggaggcagaacctttatttgcctccaggtcatctgatctgctgtgtagaaccacgacaaggctgggaacaagaaggtctggatagaattctagtcacaccatcacttgggtgaggtccttttgccctctctgccaacgtgggtacctgttgctaaaggtagactttcctgtttatcatcaaagagtgcctataggtagatgagtggggaggactgcatacattttgagagtagtaaaatcagatccacttggacaaaactgtcttcaatattctacaatgaacatgccatgttattgtgaccagaattgacattgtatctctaccctacgctgacaagttgattgtctgagcgaggaaacagcactcatcatacatttatatttctccaggaaggaaaagagacatggtagagtctagtggggaaaaatctggcttcagattggacttagtacttgaattaagggtcaggcattggcttctacctctcactctgtactcatgaccttgggaactccatgtttctaaactttatttttagttttctctttgtaaaatgagaatgatgtgtctctctcagatcagtgagtaccagctgagatcatgtctgtcgagcacttaggcagtggtaagtgccttctttctttctttgttttgagacagagtcttgctctgttgcccaggctggagtgcagtggtgcaatcatggctcactacaaactctacctccctggatcaagcgattctcgtgcctcagcctcccgggtagctgggattatagacatgcaccgccatgcctggctaatttttgtattttttgtagagacagggtttcactgtgttggccaggctggtctcgaattcctaacctcaagtaatctgcctgccttggtctcccaaagtgctgagatgacaggtatgagccgccacacctggccacagtaagtaccttcttaatgttaatcagcagagggaagggagagtgactctctgcagcaggattcagtggagctagagatccagactagcaatagcagcagaatgaagatgaatcttgactacttgattgctgcatttttcattattttaggaacccagcggttctcctaaaatgcatgccaaaggtcctttgacagggtgctgctccagctgtggtttgtcggtctgcagtgttgtaccaccctggtgctcattaggactgcaaattcccaggtcaccttcagatgtaccactctccagatgtttctcatgctcactgcagtatgagaagcactactttaacaggcaacctccttccaggtgaatcatgtctggagaagttgcttggtcagagagatatttgtccaggctcagccatgctggctctgcagcgagggttccttcactagaacaccatgcatttgtggtggcagcataggtagaaggcactgagcggaaacaagaggagcgagatggagaaagaaaaaaaacaactttcccggaaaagttaaaatgatagcatgacctttctgaatggactttgggacatggcaccaagaatgagcaataatgaaataccaaggaaggagactccttaggagagcatctgggaaccatgcaaccatgcgacaagaggtgatgcagggaagctggtgagagggtgaactgaggctcccccaggggcgaggggggatacctcctttctgaacctcatgctgaacccgaccctcaggagcaacagattggggtaggagcttttggagaggggaattgaaatggccttgttggcagaatgactctgaagggaactttccagcacacccaggaaaaaaacaaaacaaactccccaatctgccagactccactttcttaactggagggcagggtggttgctcaaatattttgggctcagggctttggaaagatttcttgtcttgctgcatgctctgtggaaccaggctgagagcaggatttttgcatttagaatatcttagcagaactgggcaagatgaaaaccaatctttttgtagctaccaaaaagtggacatacttcagctttctgtcttctccctgctgacttgggtgtatttggtgtgcttgctctgtgctaggcccttcctgtctcttatctcactaaatcttgacaatatccccagagattggcatcattatactcattttacagatgaaactgtctcagaggggttacggaatttgcccaagacacacagctgagtggtgaagctggaattcagaaccaagttcggcttattagaaagtattcttatatactacatgtagaaatgaaacgcaacgtatgtgacagccattataatgtaaataataaaagtaacaggattttctccctgccctccgtaattcagtatacttgttgattatttgctgcttctggcaagctatgattgattgctgttctgtgggatatggagaagtttgaggaatttatgatacagctggggagaaaagacatattgatgcttgaccaggattaagccaccatatctcacaggtgtttagacaaaggagaaggcacctctgctaaggcacatcagggaaatctctagggaagatactgatttgacatagtactttctgggtatatagaattgtttcattttgtttgccgagtatgttaaaactgtttgcagggtgtgttaagatgatttgcagaagaatgttgcatatattattcgttttgatttggaaaaacaattaaaacaaggagagtcttattatttgccctatctttgggtaacttctgtactaacaaaactccggctcaccagccactagagttaaaattctcactaaagaaattgactaaatggaagagaatttatttctgatttcctttttaatgtaaacatatgtattgacacttttccttggaagaagtgtagtttctcttttagtagaaggaaatagaattatactctggcttaaattctattattataaacatacttctgtttttatcttgagataaggctttcctatatactgttgggagtctatagtgatatagtcattttctatattatttggccatcatttattcttttaaattcatttataattgtttttgcatgttttattgctaacatttaatagtgaccacccattaaagctattgcagtacctaagtatttataaatttttctgacatgttattgcttctggattataaactgggaaataattaagattcttgttcttgttgtaatgctgttatggtgatgatttagtatttccccaaacagtttatataatatggtctttttccacattggtatgtttctttatttgctggacagggtattttaatggttacatctaaatggaataaactcatagagctgttgatttgagaaaaccttctataatgccatattaatctatttagctcccagacctttcttagcagatcaaaggaatttcctggccactcccagaggtctgaccgccttttatctgttttaatgaaggtaattaaaattcctcagcttatgaaggtctggtcctggtcctaagtgaactagtccccagcagaatctgaaagaggactataagcaagccatttatttctaaatttttaaccttatatttctgtagatcctgattaaggtagttcctgcagtgtgagggcaaacttaggttgccagtattttagggaaatatgagttcttctttcataaactctgatgattattttgattcctgtatcattcatttgaaatgaacctgcaacactttgtgggtacataggaatgaagcaaatgcactctaaataattaaccagttgtgtcattgatttctactgataggtttatagcaaatgactttacacaaagttattaattaaatgctgtgttctgatgttgtctaaaaaatgtcatctggatgtccacagtttaaatcctcaacaaaatgttaaaagtcacagaaaaagtctttgacatagcatgacttaggatctccatattcatagttatttgttgagtaaatgtgctttgagcacttatcatgagccaaacactgggctaggtgttacagagacagtgctgaacaaagacctcgccaatatggtgcatattcccattttacaatctgtcagctcagccagtctcttaaaggccatcttttcctcaaacgagtttctgaaatgaaaatgaaaagagtcatttaaggatttaatctgagttctagtctataccctgaccacacaatgggcctcagggagaagaaggaacaagacaataccttactagagcaaaatgacttcccattatagaacatggtctggcactttcaagataaatgaagctgtaaagttaagttgtgcaattagtggacagagacaggtaatttgtgggcatggaggaggtttccaaatattcacagcaccaagtgatcaaaagctgtaagtagcatttgtgcacttttcttcatacattttacattaagaaaaaaaccatataggttgatattaagcagctaactgaaaatgaactgtccttaaaaagtaagtaaataaaaaacagcacttttcctgatgaatgaaggactgtgaaaaagctgttatgggcttagcctatgtagttcccagcattattttaaaaagatgaagaaaagaatgttgaagtctttgcattttcaatgcctaccaggtgcacctgccactcctgcatttctgggtttcacttttgtccattgctagctctcatttggtctgcaaatgtctgagtatctttcatgttccaggaactgtttgtgtgagatagatgcaatggtaaataagtcaaggtcgtcaccttttaggacctcatcctaccaacttaataggtgctagcagagactcgttgtgtgtctattataggataagtgagtgaaagtcctccttaggtaggtttcatcatctgcacttggatggaatgaatttatgaatgttcttagagacacttatagatctgagaaataaaaaacacataccaagaacttattgttgggatgaagaagagtaaataggggaattttttgggttcctcttctcctcatcctccttacaactcctcctgctgataagatatttagtcctatgattgacccagactgtcattttttggggcccttctctccatgcctgtggccaagccctgcctgggcttgtattaccagggatgactccacatgcttcttgcctgctattcacagaaggccctcttgtcttccgtgctcactgcgtggatggaacacccaggcaatgggacaccaggggtctgtatgtgctgcctgtgccagtgttctgagaagctccctgagactggtttggtgtaagggctgtcagtctgctccacaaacccagaataaattggattggaaaagtaggaaacctcatttagcttttgtgcctaaactttgtatacccaagcactgtttaccaaaaaagttctggatttggaagtagttaagtattcaaaacatattcaactatttatgaaaatgatgcttattattctatgtttatttctctcagcagggaagcccaaagagtaggggagatgaggagtaggttgtggaatcaacacccttcctcctgcctccaaaccacctgcactgcccaaggaggggccattcttttttgggagcccattatgtacttagctgtggatgagggtgtatgtgtgtcttatattcctgcttacattatggatagaagattgaaggtcacacttctgtgggtgtcctactgcacccaaaagggtattttacataaagcatgaataattgcaccttttcccccaaatgtcatatactttgatataacattttgtagagttaggagtcaggctttcatggggaagagggctgggttatgtccagttaatgggcaggcatgtagattatactttgcttttgataggtgagggactctttcaagtactattctacttcctctgtggttagtttttttctcccattcttctattctttttcatctttggggctgtacatcaggggaggagggtgctgcagtttgctattataatgggaaaaaatgagagagaaagcaaagagagtaggtaactgtactcagctttatttattttatccacacctcaagctcttattaggaaagggtgggttcttcttttctttttttttaggggggcggttttcttatagaataattactggtattctctggttgataagctaagagaaaagagagtcagggaaaagtactttactgtttttctatgttgtgttcattggttgtttttgtctgtctagtaccaaactttccaccaaccacataccctcttcacggttcccctccttccttctccaacagggaaaggcaggcaccagtggattcctctgtagtcaagacttaacataaccaggaattcttcctaaaggaagaagctatcaattagctaattatacttttcccatcccaaatttgttggacttctttgaagacaggatgatttaaatgagtggagaaggcttacctgggtggagggaagcagggagtaccaacgcatagagtgggaggaaggttggaaatatgagtgagagaaggtgttgatagtggaaggttgcagagaagttgtctgagaacttattcagagccagatggaggaattgttctactgattctcaagaagaattgagagttcttgcagcaattgttattatgtggttttgcaacttctctataatctcttataagagtagtttctcttagaagcctagtcagtatacctgaaactttaattccacttaccattataatgagaaaataaattgtcttattagattctgtgcaccaaggggcaagacctgaaaggaggatggaacggtgtgtagcggggatggcagttgatctgcaaaatcaggcatggaaattctgaactgttattggagagggaaaaggaacaagctacagttaactggtaaaactcagtcatattataggttaatcaaggccatagactgtgtgcttggtactatggaagataaagtgatatggaaagcatgatcagtgaccagtgggcttgtaatctaaatgtggagacacccagaccttagaaaataactatcccataggattatttttggcaaaatgtcaaatgaacaggtcatagataaatgatttaagaattcagaggaggtagagctcacttctacctggaagggtaagaataagcttttgttgacggggagaggctggaggtggaccttcaagggtgggtgggacagagatttgtcagcagacatgaatatggggtgctgggttgggcactttacacatcacagtgtggatacaacaccctggaaaaaccctatcactcccattttagagtaaggaagcataggctcagaaagtataaatatatgacccaaacttccttaaccattgacaggacaagttatagctgaatttcagacttaagccctctggctccaaacccatcctattccagtaccagtttgcctttatgaccttctatacacagaaatgctctgagaacaagaaagcaagtattttgcacccaggatggaaaccacatcattttggtaagggtacaggtcatttgggaaaaaatgagtgatgagtttaaacagtggtctaggtttggaaaaatagtctagaactattgaaggaatttcaggcagagaatgaggtcagccaaactatgttttagagagaagagctgcaaaaggaatgattttgtagaatatggcaaatgtttatttaacttgtagcattttaaactagattacttttagcttaggtctgcatctgaaaatcagtgatttacgtagtcaacctttatgaaagttttctttgattagtcaatctagaaaagcataggctttattttttttaatttttatttctcatgcttgtgttttgttgcattgcgtttatcctggatgccttaatgaaatggtgcgatatgacccagggctctcatctgtttaactttgctaatttgctccattttcaaatgagtttccttggctgcaggagcagcagcagagcatgaactctgctgaaaggaatttcagttacaccgctactgccacctctggggcccccggataattttcttatcgtctttttgccgtttgggaacaaagccacgttgttcacgactgaaatacagtttttaaatgtgcctcctaccgtgtttttatagaaagagagcctcttctcctggaaaataaaacaccattgattgaaccaacagcccttcgaaagggctttaattattgcattaattacaaacttcaggacaaaccagggcccagtagtagggagccattgagcagatttctgagcggctttaaagaaaatgttaaaagccttttagatctaagaggctgaaattgagagaaggaggtgggcatgtgggagacactaccttcttcaagttataagctttgcattaaaaaatatcctcttccctctctgatttgtgtttcctgggaaagctccaatgactcattgctccaaggcctcaacattttctaccctgacattgatgagagagaggaaagtggggaggtggtctaaatgtcatagagtagaacttctccaaaaaaataggtcactggggaaaaaagaaatactcttggaataatcctttaacatgatcatcttcaaaatgctcactttttattctgaagaaaaagaagaaagaaaaaaggcaagtaatttctttctctggcaaaacattcactgaggtgttttcattcaattactttgatggttggctgttgggaaaattatcaaaagtgaatatgggtttgggaactactagaagattctcaaagttgctttttatgatctctttcccagggaaaataaatcattaaatactgaggtggctagatgaaattgaatgctacatctcatggtttattcagaatgggctcttccatctgacatccttttgacaggttctaccacatgtggcatttctggcaggtatgagggtaggtttcacattctaaaatgaaactggcagtcacacgtttccctggtttaaaacattttagcacttattatgtgccaaatagtgctctaagctgtcaacatgttaactcatttaatccttacaacaattttgtgaggcaggaactattataactatttagcagataaggaaactgagccttagcaaggtcacagtggagagcaggctgtccggctccagtgtctacttaattctaaccgaatactctgggagacaaagacgttcgtctcaattcatatcaccttgaatattcattgccagttgatgattgttattcttaattccctgcaaagactcaaccagtcaaacaattaatcaaatactgatttaccaattttctgggcacaagattaggcattaggagatgagtaaagatcccattcctacattaggagttcccaatctaatacagaagatggataagcaaatagggtgccagaggttggagtttgtggctcagatttgggagggttcatttatcaattcattattttaacaaagtgtagtgctagtatatgccaagcactgtgagtgattcccccatcccctgctcctcagtggttgcagtctgatcaggggagatggataagcaagcagcatgttgcattttggtgtgataattgctgtaattatgggcaagtacatgcaggggtactacatttgtaaatgtaccaagggaggtaatggcctgttcaggaaactgcactgtgacttagcatggctggagggtccagtgaaagcacagagaaggtaagaggtgaggctgcagaaggccccagaaagggttgggagtcaaggacattgtctgccatttcagagactctggactccattaggacattgagaatgttacttggtacccagcagtaagagttccttttcatccaagctctcatgtcactttaattgaaaagtagaaaagcagaaagaaagagtatcctaaaattaagcaatgataagacactgcaaatttccgaagattggaaattgccacttttatgtagagcttatggctattttctcgctggagacagactgaaaaagtgaggtccatatctgtgtctatttctgggatattggctcagcaataaagatgttagaaaaaataaaatgatggggttaaaaatcaacacatgtcacattaatttctgattcttctattggaagaggatcacatttcaaggtcaaaagatggagcagtgagatttgtagagagaaaatttatgggtggatatttgaaaattttctataagtaagcattgagaacattacgaagctaccagattttgtaattttcaaaattacaaggaatgtagtggaattggataatggatggtggaacctcttattcttggatcattggtttagatagatcccagattggcaataatggaaatttatttcaattttatgtctgctcagtggctgaaatgaagtgggttaataggtgcagttttgctttttgtggaggaatgccctagtcacagaaacccctaaagcaaactggcctttatatccccccagatgtttttccaggatgggtagtaacagagagggatatctctttgtcttggatttcctttatattgtgtgtcaaaatggacagtgtacaaagagtactattcaaaagtgtgagactaatctcagtttattgtgaaattcaatggatcacaaagtactgtgtccccaaaccaaaacagatgattggaaaattgaagactagatatttggaattgcttgaatgctggaggatggtgtgggcaggggtggaggcctgggtttctggcatgtaaccctaaagtcctttttatctttagtcttgtattctacctgagtagtaggtattgtgaaaagtatgttttctatgagtttacagatacagttcctggcataatgtacagcatatagcaggaatcctgtaatcattgaaggagttaataaatgatatcatcagcatagaacagtttggctgctttatgtataactcaggctactacagattgggtatctcttatgggaaattcttaggaccagaagtgttttggattttggatttttgtggaatatttgcttatacataatgagatatagaggggacgtgatctgagtctaaacatgaagttcatttatgtttcatatacaacttatacgcatagcctgaaggtaattttacataatatttttctttttctgttttttgagacaaggtctcgctctgtcaccccaggctggagtgtagtggtgcggtcatggctcactgcagacttgaccttctgggcacaagcgatcctcccacctcagcctccctagtagatgggatgggtctacaggcctgcagcaccatgccaatgcccagctaatttttgtattctttttttttttgaaatggagtctttcccttttgcccaggctggagcacaatggagcaatcttggctcactgcaacctccacctcccaggttcaagcgattctcctgcctcagcctcccaagcagctgggattacaggcatgtgccaccatgcccggctaatttttgtatttttttgtagagatggggttttgccatgttgcccaggctggtctcgaactcctgggctcaagcaacccttccaccttggtctcccaaagttctgggattacagacatgagacactgcactcagccttatacaatatttttaataattttgtgcatgaaataaggtttgtgtacattgaaccatcagaaaaaaaaggattactgtctcagtctcccatgtggacagtctgtggttttttggcatcaccgtcactcctgactctgaatttatatgctactgataagctttgtgttcttacacttattcacgcataagtacttaacagtaaaaaatatgacatgcatatctggtgtgcacagaaaagatatatcacagatgaaggaggctgggagggccttttttcccttggggacattgaataaagcatgtgtgtgcacctgtgttttgattgcgactggtcacatgaggattgggtgtggaattttccacttgtggtgtcatgttggtgctcagaattttcagatggtggagtatctcaggtttcagattttcagatgagggatgctcaacccataaacccatatagagataaggagtcttggtacaacatgtgctttatagaaaggaaaattttaggtctcagttgtagacttagagaaattcaggactaagacatttctgtgcatttagttccttttcatttttattttcctaccaccttcccccagccagctttcatctttttctctcaaagctctgcaaatcattgaaaaaattttccatgttattttttaggacaaaaacttactaaaagtcatccatccagcactgagttcttactcacgggggtcaccactgctgtgttctagttcctttgcttttgttttgttcactggcccctcctctccaatccctgagctcctacactgcaggccttcctttttattttacgttttacactctcccaacctgactttatcctttcaatcaaagatcattaataaatcttgtattgccattacctcataaaataagtattccatttaatcacattatctatgtatctgaaatcaggaagataccgaaaggtggtaaacaggaaatgggaatattggcagaaatgtactactgtacagctgagaattgtcattctctttgtttttttttttgtcgaaaataaaccttctgacagagatgatcagagaaagggatcataagtggtttcatatgaatatcaagattggctcccattacattttggcactaggtgttaagtttttatctctctgatcctgataggtggtggtacttggtgggcagtgtcatgaaaaccaagagaaccagggccttatatttcttttattttaacttgggtttttattttttttctttgcaacttttatattatgttcaagggggtgcatatgcaggtttgttacttgggtaaattgcatgttgcaagggtttggtttacaaataatttcatcacccaggtaatcaacataataaccgataggtactttttcagttctcacccttctctcgccctcaatccacaaataggtcccagtgtctattgttcccatctttatatccaagtgtactgaatatttagctcccacttataagtgagaacatgtggtatttggttttctgttcctgtgttaattcacctaggattgtggcctccagctccatctgtgttgcttcaaaggccatgatctcattttttttaataactgtaaggaactcaaatcaacaaacaaaacataacttgagttttgagaggtgttttctaccagatacttccctttgaactttgtatgtgacttcctagagagaaagtgtgttgaggaagttcactattctattctgcagtgagagaagacgacaggctaccagggaaaaatagaagatcaaaacctttttatttatttatttttgtttgtttttaaagtatctgtttccatatgtatactattgtgcaaccaattagttggggatagcggatttttatgtagctggcaaacttatcaggcagaagagaattatcatgtatatttcagcagcaatttatgaacaggtttgtttctaaaggatgcacatgtattttgggtttcactcttagtttcactctgattaatttgcttaataaatcttccttcttaaagacagaggagaggcaaacacaagtcaagcttttgttttagccagtagatttataattaatgacttttgttgatttaagaagctttctgaacaattcttggaatgcagtggtggcatcatgaaaggagcaaagggaacattttcgtgggacataagtaagatttaggagagggaggagttcacagactatcattaattttacaggaggagaaaatcaatgtcagtaggaaaaaagatacgtacaaaagatgacttctggatttgaggaaccattctcaatagcagaaaatagagctgttctcaagacatatgttaggtctctcacaatctatcagcaataaaaaaagatagcaatatagagatgaaagaggaagagagaagaaggattaagatcagctgtcaaaatgttgcatacaaaatgtattgaatgtcactattataagaggtcttactgtaattaaatttcctgtctatttggatttgctcatcttaaagctttttcagttgtcagtgtgagaaatgtttcctatctaggtgttttttcctccctgttaagtatcagcacagtgtaattcaccatagttgggtagggtggtactgagaatgtttcctacctcagcaagcctaatgtatatgattgctttttgtgaagagttttttttccatttctaccattaacaaggtgttagacacttagcttggtagtagacaaaccattagatcaatattcccagaactagagagttctgatattggcaggcattatttattccattaaaaaatgtcatattcatttaacaaagatggaatgcagatagtttcaccgaagccatgagtgtgataaaggctatagacaaaagattcctgtgaagtgaccatctggaccagtttaggtgttaggatttctgaggttcttgaacaagagctgttcctgctagctcatgttttagaacccatgtacaggaaaattgaggttgtgtttaaaaaatatggcatgtagcacaggaaatatgtgttttcagagcaaatgataacttaatattggctgaataatttgtaagaatactgatttttttgtcatataacctatatattttcttaaggaagataggtttataaggaaaaattgcaataattaaactgagcataccaacaaggaaaaataatttaactattatgatgactcatttagttggcatcctcgagtaatgaggtgctctagattaattttcctgagagcagaaatatatccctttaaatgattaagcattttatcttcatcaatctttgaataatatatttccaagatatattttacattcctttgtgtcataaatatgctttacaatgtatagggctagaatcatagtttttttttttttttaagagtttaaagaaacactgggagatcttggaaaataatattaccacattggagtgcaacattcttgtctctgatatatgaggttttgattagatgatcatcaaaattccttctctttctaacattctctaaataaaaagtcgtttatgttttaaattgtagtatatataagaatcagctagggtctttgttaaacttgcagatactcagacatcatccctagaggttctgatttagtagatttggtgggagagaagagaatccgtatcataaataatcacctagagccattctgatgacctcatttagagaaacactgattctctttccactcttgtataacagacaccattactcttgctggccacgtggtccttgaaaagatcattgctgctttaccctcagtggcattgagttgtgaggggctgatgagactaataactatgctttgatagtctttgctttctgaacctttcctcagtattacctgtcactttgttaatggtagctactgaggaaaaccagatcatcaagcttattaaatcagatgccctgtacttgtacatttaataagtcattgagttctaatcttaggtctgggtagaggcaggggaaggactgtctattttctcctgtagtctaaagtgcatgcatttagcagtgatgattatattccctgtttggaggtcttttactcttttgtcatgttctggttgttttaagaaagtcaagttttctagaagcatgacgtcagaataagtggcacattactctataaatatcttaattttcatggtgagattcatagtcaggatggtctatgactttcaaatattaaaaatttaaatataccataaaattctcctttaaagtatactgttcaatgatttttagtaaaatctgtaaatttagagttgtatgaagccaacaccataatctaattttagaacatttccatcatcccccaaaagaaatcaggtaactgttcccactcctaaatccagtcaatcaataatttacttcttatctctatagatttaccttttctagacatttcatatgaatgagatcatacagtatatgcccttctgtgtctggtgtctttcagttagtgtaaagttattgaggttcattcatgttttagcatgaatcagattgccaaataatattctgttgtatgcagttactacattttatttatccatttaccagttaatggacatttggattgtttccactttttgactattatggctagtgtgttcaaatctttgtgcagacatacattttaattctacttgagtagttttacctaggagtagaacttctgggtcatatggtaaatctgtttcaaggtagcagtttcacatgttacagttctacccgcaacgtataagggtttcactttctctacatccttgccaatacttattattattattggatacaagtcccttattggatatatgattttcaaatactttcacctagtcagtgagttacctttttactttctgaatggtgtcctgtgaaacacagtatattttattttgatggatccccgtttatctttcatctatgcatctgggtactttttttttttttaaagaggaatctttaacccaatactcatgccttcttgaggcttactcaagatcttgtaagctttgtttagtatgaagtccctagtgatacctagcatatagcacctagtttaaacagattacagatgaatattcaaagtttttgacctgaatttactgtagtcaacagttaccctaaagccttaaagattaccaaagccatgatagactcagccaccatcatgcaatggctatgtccttcgtagcatcctttcttcacattcatctttgctttcagcatatgaaggggggaatgtaggtctttaatttaccttgtactgtggggtagcactatcctttccttactccattttcaggcccttggatgcaggacccttctctgaggtcccacagaggtggaggcccagcctgagcttttacaggttttagagtaagatgtcaggacagcagttcacactcagccacatcccattaaaagaaataaaaaagtggctgggcacagtggctcatgcctgtaatcccagcactttgggaggccgaggtggatggatcacttgaggtcaggagttcaagaccagcctggcccacatggtgaaaccccatctctattaaaaatacaaaattagctgggcgtggtggtggacacgtgtaatcccagctactcgggaggctgaggcaggagaatcacttgaacctggaggtggaggttgcagtgagctgagattgtgccattgcactccagcatgggtgacaaaagcaaaactccatctcaaaagaaaaaagttgctgctgtagagttttgtcataagaacatactggctgcagtgtccataggcaaagatgaagctttactgagggctgatatactcaatacttctgcccagtccacttgagtctgtctttgcctaaatactaaattgtttgaattctcctttagttttagattttccctactgaattgacatggagaaatgttatcaagtccaatttgcaagaatgctggatttccacttggagcttttgttttcttgggcctagaaggcatctcttgtttataaaaaaacactgggcatcattgtacatgagaaacttaaagacagtgcatatctggtagcagttgatatacagtgtattattcctaaatgtagtaataacaccttacaattggaaaaaaaatgagttatagatgaccaaatgcttccataaatatgatcacatttggtcctcccatctctgtgaagaattattattcctcttttacaggtgaagaaaatgacttgtcagaagtcatttatttccaaatataggacttctgataccaaattttgtgccttttctgtagtgccatgcttcctctccaaagcaatagttgaatttctgcaattttaagaaaatcatatatgtcgtgttatattagacccgtggctaatctataagcagtcatttatattttaaatgaaatccattaatgatatattcactttctagggcttatttccatctcaagcttccatttctgattgtaatgtgtaatgttgcatttcctgtgaaaggaattccaggctttggattgtaggtgggtaagattagtggtgggtcttagagagtcgggagatcctgagcatgggaacagccttttgcccgtaagtttatactgtgctcaaagatagtctgaatagttttaggctgcctggggtcccaaggagactttatgcctcccgatagtaaattttgggtccccaaagacccaacaatatttccatgcgatcatagcttgaccccaatttatggatgcttccttcctttcttctttaatccttgacaactttcttccccaagatttcctcgtgtcagggacccagaggccattcttactatgatctctttcttttccatttcattccctatggcttagaccatttaggtggggcagtggttctcacagtgtgaaccactcatcagcagcaacagcttgttaaaaatgcaaactcaggacccaccccatatctgcttaatcagaaaggcctgggaggttgaaccctccagtccgtgtttgatataccttccaggggttctggtgcatgcgcacatgtgagatccacttgtgcagtggttaagagcaaggattctggaatcagcagccaggtttcaaattttagctctgccatttggcagctaccacttcctgccatccatttacctatatgatctttggggaaattactttcctctctagactttaatttcctaatctgtaaacttgtggaataaaatatgaattacctacatgggaagttgtagaaatgaaataaggtaatgcatacaaagtgtctcacgtgatgtctggcactctgcaagcatccctgaatgggagctttcatggttgatatggactctgaccctagtcattgcctgcacagtgcttgatgaccttcccttgcttgtctctagcagcttggcatttaactactcaattctaaacctgaatgtttgccatgtgctccattttcagtagtatgaaaatgagactagttttcacactaaaatccctgtatgaaatatatttgaaattttgcttaggtcttgcttttgttttctgccacccagccagtttcctatctgggataggacatcgcttttgataataattcaatatttaaagcctttgtttaagaatgtgtcttaagacatgtttaaaagtctaaataaacattatatcctgtctcaatttatctaccacttaaaaaatttcaagtgttttttatctatctatgtctatctattgatatagaatctatgtagggatatagaatctatggattctaaatagattctatatagatatggataggtttgatatccctatctgtggcttttctcctataacatttttctaacttaattgtcagaatctgttctctagtagaaaatccaccgatgtcagaggatcacttgagtctgggaatttgaggctgcagtgagctgagatcatgccattgcactccagcctgagtgacagagagaccctgtctcaaaaagttcatcaacatacagtatacttccaacaaatccacagtaaaatttaatgtattggatcattttcagactcgcggcagccagtccttgggctatttctatgagtctttatgtaactttgactacaaattcgaagttgtcctcaaatccactagaactcctggttggataccattcaatcctggtgatttattttacttttatttgtcagttaggcctagtacatcccttgcatttatttttcctgaatttagcatatttagactgcttacttcagaagagaatttgttttcaaatattctctttggtaaaatatacctcagaagttggatttattccctttcctatcttttattcatctatgtactgcacttatttttataagttcatctgattcttcagctggctttctgccaatgataaattaaaaaaaaaaaactacacataaacgaaaccaacaaccagaaaacccttttaacttgttatttatttatttatttattagcaacctttaaactctttgaattatgtcatgaatttcctctgacttacaagctcacagggcagcattttctaatagtgttttgttttagcctgaaataaaaggttccatggtcaagttagcataggaaaggctacatacttattctatgcccctttatcccctagcctctgaaacagtttagtaattcataattcacagtagcatttgaaacactctgagatgtcctgcatagacaaaccagattaacttggtttgacctaatttcccccccaacataaacacttattaacaatctgtgaactagtgttccttagaccacctttgtgtccattgaatttagaagttttcttattctcatttggcatagcttaatgtttttagatgtgctttagttttttcctctttacctatttgtttctatttggtttcttcacttacgctttttccatatatatttttttgacaagtctgtgtgacccaatttaaacttttctgatgacatttactttgaattaaaaaagattttttgttcattacttatcttcctatattctatattgaaatgattattttaatatttaatgttatagcatattaatttattaaagtattaaatatttatattattaaatttattttaagttaaataatcaaataatattgatattaaatatttaaatatttatatttaaataatatttaattttaactttatattgatataaaattatttaaatattgataaggatattactttggtagtactggtggttataatgtttttaactgtctttcttattcactgaatatattcactgactatttcatggtaggtttttaagctttattgcttttattagggaataaatgactaaagttatatattaacatttacatttgtaagttaatcttcaccataggtaatttttgctttttaaaatttgttgcagtactctatatttccttgcgatacttactctctttgcacatgcttcttcttttgcatgaaggctcttgttccagatatccacatgtctgtttcctttcctccctcagttctcttttcacctgttgtcttctcaatgaggctcatttttgctgctacatttgtttttagatgtatttgtaaacatctagacaccctaccccaacactacctattccccttcttgacttcatttttattttttgtgttgatcaatatgtaagatactatgtatttcttgtattcattgtatttatttgttctttcttaatagaaagtaaacttcccaaaaacaaggattttcatctgttttgtcactgctttgtctctgctgtctagaacagtgggacatattttaggtgctcagtaaattttcaattggatgaataaatacaataatctcagaagatgtaaaaactgcattccataaaattcaaaatccattcatggtacaaaatcagtgaactatgattaaaaggtaaaaacattgagcaaacatgatatttattggtgaaacattgaaagtattcttttttaagattacaaacaagttaatacatctttaatcagcaagataacatttctatgcagcattattatataggaaattctagctaaaacaatacaataagaaaaagaagaattattagtattgaagaggaagaaacaatgctatccctagtcttagaggatattttgtctgcatagtaaccatcccaaaaaaatacagattaagtattagaatgaataaaagaggttatcaaatatgccacaaacaaaatcaatgtacaaaatcaattgcatttctgtactttgctacaaatatttggaaaaggtaacaaaataccatttatagtagtatacaaaatataaagtacctaggaaaaactcttagaaaaacaggaaaagacctgtgtggagaaaatgataaaacaaagatccttgagaaaacctaaatgagtggtaaaataaatcatagttctgagtagaaaaataccaatctacaaaagatatgattctcctaaaattgtttatttttattttttatttttttattattatactttaagttttagggtacatgtgcacaatgtgcaggttagttacatatgtatacatgtgccatgctggtgcgctgcacccactaactcgtcatctagcattaggtatatctcccaatgctatccctctcccctccccccaccccacaacagtccccagagtgtgatgttccccttcctgtgtccatgtgttctcattgttcaattcccacctatgagtgagattatgcagtgtttggttttctgttcttgcgatagtttactgagaatgatgacttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaacaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactactttacagtcccaccaacagtgtaaaagtgttcctatttctccacatcctaaaattgttttagaaattttatggaataaaaatataaaaattcctgcacctttttactcaccatggaccatgcaagctcattcctgcccgcacacagaacagcgaacagggagttttgccctcccagatattaaaactgtgtactactataaaaatagcaattaacacagtatagtattgagtagaaaaagaaaataatagatgatttcagacagactagaggacccaggaagagacccacacatttatgtaaaattctttataaagacttgactcttaagacaggtaaatgcaataaatgctacatgacaattggttaactaagtggagaaaaaaaatggatactacctcacatcacacataaaaaaatcaattctggttgcaagacaaatctaggaaattgttagaaaaatatatataagaagatagctttatgacctcagataatgaagaattttaaaaacaagatacaaaaagcatgaaccatatgggaaaagatttagttttactacattactaccctatttatccttgttaaaatgttcagtagctccaaatacaatggaaaaaagactgggaccagtgtctcacaaaagagaaaacacaaatggctaaaactaatatgagaagatacacaacctcattagcaatcaaagaagcttacatttaaatgacaatgacatatcatgttccagccagtatattggagaagctaaaatgagtaatagcaagagctgcagaggtatgggagaaacagaacattgttagaaaggaagtaggttgttagaactaatttgcaaagtactttgactttatcttgacaagtttaagataccttaaatcccatcaattccattccaatgtatagactctggagagcttttatatttatatatgtttatatttattatatattatatataattatatgcattatatatattcacacacacacacaggagatgaccataatattcacagaatacttgcttggaaaattttagtagactacttttagagcaggtttaggatcacagcaatatagagcagaaaatagagttcccatatagccttcatccccacaaaagggcaaccttttcactatcgacatcccaaaacacaattgtgtatttgctgcaattaatgaacctatgctgctgcatcagtattacccaaagtccatagtttacattagggtctgctcttagtgctgtgcattctgtgagttttgacaaacctttaatgacatgtatctgtcattgtagattcctatagaagagtttcacttccctaaagagcctatgtgctctgcctattcatccctctcttcccactaaaacctggcaaccactaatcttttcaatgacttcatagttttgccttttccagaatgtcatatagtggcaatcatacagtaggtaaacttgtcatattggcttctttcgcttagtaatatgcaattaaggttcccaccagcactgaattcccatcagcaatgaatgagagtttctgttgctccacatcctcgccattatgtggtgttgtcaccgtttggattttcaccattccaatctgtagaatcattgttattaattggggggagagacaaccaacaaataaaggaaataactcagaggttcgttagcagaatgattttaaaaattgagggctgtgcatataataaagtgacataaaactatatacacacattgtactaaagtcgatttgctgttttgatattgtactgtaattaggtaagatgcaagcactggggaaactgggtggagggcacatgaagcttctccatactatttctccaactttccgtgtgcctataattttttttcaaaccaaaatgttaaaaaaaattcgagtgttgttttctcatagataaaatactgtccagctatggaagcaatgaaccacagataaaaaccacagggctacatctcacaaacgttatatggaataaaaaaatgcagtcgaataaaaacagatgcagtataatgctcaaaacatacaagctaaatgatatattactttgggatacaactgtgataaaactcaagaaaaacaagtgaatgataagaaacagaattggtgataatgcttatctcaggggaacccccacgcttttgtgagttttacatgcaggagactatcaggtcctcatagtgaatatcggagaataattcagggggattggaaaaggaacattttgaaatataccagagcattctgtgtattcttattaactaacccgccctcgggagaaacgatcttcctagagtctaacctgctgaggttttattagagcctaacatacctgggctaagagaaaggaaggaggtttcatacaaaatgaagcgttctcttaccacatgatccagaaatcacactccttagtatttctccaaatgagttgaaatgtccacacaaaacatgcacatggatgtttatagcagttttatttatgattgtcaaaacttggatgcaaccaagatgttcattagtaggtgcatagagaaaaaaattgtggtacacctagacaatggaatactattcagtgctatcagtgctaagaagaaatgagccatcacgtcatgaaaagacacaaaagaatcttaagtgcatatcattaagcgaaagaagccaatctgcaaaggttacctaccgtatgattgcgattatgtgatattctggaaaaggcaaaactatggagtcgttaaatagattagtggtttagtggggagggaagcgtgagtaggcagagcatgtaggatcttcagggcggtgaaactattttttatgattctgaaatgatggatgcatgtcattatacatttgtcaacacctataaaatgtacagccctgagagtgaatcctaatatgagctatggactttgggtgataataatgcttcagtgtaggttcatttattgcaacaaaggtaccactgtgctgggggatgaccatcgtgagggaagctgtgcatgtgggtggggcaggggctatatgggaactctcactactttctgttctatgttgctgtgaacctgaaactgctctaaagtataaagtttaaaaatttaaaaaactctgatctttagtttagcattttacaatctattttattgaaaggaacaaataaaagttaggattaagagaattaaacatttttcatagagcatataaatatagagcatgtaagagaagacttgattctcatttcagttctgatctgtctttaactttggcttagctggttttagctgatggtttttgaaggatggtccccagaccagcagcatcaataccaactggatatttgttagaaatgtaaattctcagacctcaccccagacctattgaatcagaaactctgggagagggactgctatggcttgaatgtttgtgttccctacaaaattcatgttgaagcttgatctccaatgtaacagtattaagaggtggggcatttaggaggcaatgattaggtagtgaggtctctgacctcatgaatgggactagcaccttatgaaaaggctggaaggaactacgttggcctctttggcccatcaatctcttctgccatgtgaaaacatagcatcaaggtgccatcttggaaacagcactcgtcagacattaattctgctgggaccttgatcttggacctcgcagcttccagaactgcgagaaatacatttctgttgttattattacaaagtgtcaggtattttgttatgcagaaggaacagactaatacagggactcagcagtttattttagcacaaggcttccaggtgattctgatgtgcatagacttttgagaaccactattactttcaaccttttcatctataaaattataaataacactagatcactttttttcaacgtgtgatgtatatattactgatcatgtgcaggacagttttaggtggcataaataagagcattttaagttttaccagctctgtatttattttaaagtttgttagaaaaatataaatagcataccaaatctacaagttcactggtgtttttgcctcatatatggctaagttaaaaaaaaaagaaaacaaaaagagaatcaatggaatcaatttgaacttgatataaatagaaatagccaaaatagtaaggtgataggagaatatcacaaggtgcatggagtaatttctcaaattttgaggccttagtaaccctgcactggattaatctcctacgtattttcattctaaaactatgagatttcatatgctcgtttttcttacagatttgcctccttaattttctttttaaaattcaagctcacatattaaaaatgtagtcgatgctgtttgagcttggaggggaaatggcctattagtgtgcttttgtactgggggatacttatctgagattcatatttaaccatggttaatggacatggggataattcacatgcaaatcatcaaagttaaatatattaagaagaaatctgtcctgaaaacaccatttaattttagaagcattttcttcttttcactacttgaagtatttatagtggaataggcagatgtttttataaaaaggaaatgaaacgacatttggggacagtaataaacatattttggttaattagggatttatactttgtaaaagttttcacattataaatagctaaaacatagctggcctttttaagtggcagtttaaacagctttattgagatataatttacattgtcatagagtccatctacataaagtgtacaatttagtggttttgtgtattcacagagctatgcaaccatgatcatgagcaattttaggacatgttcattatcccaaaaagaaaccccatgttcattatcagttactccccatcccccatgtagttccaaccctaggcaactacttacgtactttttatttctatggtttttctcattctggagattacatagaaatggaatcatatatgaagtggccttttgtgactggcttctttgacttagcatgttttcaagattcatccatgttgtagtgtgtgtgtgtcagtattttattcttgaataatattccatggtattgatatatcatgttggtctatccattcttcagttaatgaacatttgggttgcttttactttttgctatataaataatggtactatgaacattcatatacaagtttttgtgtgaacatatgtttttatttctcttaggtgtatacctaggagtggaattgctgggtaacaatacttaatacttgatggtaactatatttaataattcaagaaattggatataaagcactcttattcaaagtaaaattgcgattttatttaaaactaactacatttctgttttaataaggtatgaattttgtttgtcaaggattttacataaaatctgtctccaaaatggtgtttggcaaaaatcattattaaaatacatgtttttgaacacagcagcttacagactgctattctacatcacagtttatcatcatttatcaaaattgtcatgtcctctgtgacatgtttctttttctgaatattttattgtcacatgtgtcattaagcatttagaaaaaaaatggcctggaatcttcttcctgaactgatgaaattcatgatttttgtgtatagacatttacaaataaattatatgttgttaagaaactaatggtagttttttttcttttaaaattctcacttcaacatcaataaaaaatgtttctgaaatggaaacataccattttgatgtctaactgcatctgacacttttaagttttgctgtcctattattaatattttaaagttttaggaagggctactttttatataatgagattttatattccataaattattatttgactttgttttactttgtcacaatgcttcttcaaagcttttttgccaaattggctacctttagattcctttttaggaaaggtcttcaggatggtcttttttgttgtttttgtttttgtttttgttttttgagacggagtttctctctgtggcccaggctgaagtgtagtggtgcaatttctgctcactgcaacctccgcttcccaggtttgagtgcttcttgcgcctcagccttctgagtagctgggactacaggcgcccaccactacacctggctatttttttgtatttttagtagagatagggcttcaccatgttggccagactggtctctaactcctgacctcaaaggatctgccagcctcggcctcccaaagtgctgggattacaggtgtgagcctctgtgcccggcccaggatgctcccttttaatagctacttaggaaattaggttttggtaccttgttgttagaagagaatattcctgaaaaaaggaaacaactaaatgcatcgactatctggggtagtagaaagagaagcgacagcacagagaaaagatgccccttagggaggagaaagaaacaaatatcaattagacttgaacgaactaggtttctttattgatgaagaaagttaagccacactttaactttccttgccacactaaaagcaaacaaacaaaccccaaagaatagtcaagcagctgagacattcagtagccttgtaggcaaaacaagacatattcttattgttggagtatagttgtgtaaggcctgtagcccctttcttttgactaatttattccttttggaatgaaaatatttactcaatgcctgtacctgatctgcagactgatcagctgaaatcatccttgattttatttctgatagggagaacctgtcctgcacttaccatggtagagtagtgggtgtttataatgaagatgtaaaactttatagtttggatcatgtgggaggtagactctgatacagggcttagagtgtttattagggagtgctgttggaaacaacacaatggaagagaaaagaatcaggatcagacagatggaagagtcaaggtgtttctttggccaacaacatggaagctttagaactgaaatggttaatcagtttagtgccatgtttggccaaagtggccaggtctttgtaaaccacctccattagtaaatggatgcggctgtcacctcccacccaccagagcatgaccttaggtcaggcgttctctgcagctcagactgttccagcccctaaaggggcttacagctgggattgtcctctgacaacactccctacatctgggccaagaagttcttccttgaggattggtcttgatggtgtttctcctatgtctgctgcactacatcagtcattgtccccttaaccttcacaaaagcttttgaaaatatttatattttttgtttataaaagtggtacaattagacaccaatctgtattcaacagggcaatggttaaatccatgactttggagactatgtgtgctcttgtttgaatgtttctatctcccccagatttatatgttgaaacctgatctccaaagtgatggtattaagaggtaggacctttggaagatgattattagatcatgagggtaaggctctcatgattggattagtgcccttatataaaagggccaacggagcttgtttgtcccttccaggacatgcgaaacgcagtgagaaggaaccatctgtgaggaagtgggccctcactcaatctgctggtaccttgatcttggacctctcagtctccagagccatgagaattgaatttctgctgtttgtaagctacccgtcaacgatattgtcctagatccgcccaaatggacaaagacaatttagaattaacataatgaggaaatctgtgtgtactgatgagaaaatatgtccatcatgtcatagactaaaaaaaccagtttgccgactatacacatatatacactatgattatatttttatttacaaaagctatacaagtatgtaaaatacacaggtacgtgtagattcactaaagcttttaccttctgaagactgggttgggggtaaacaagaagagagaatgatagttttcaatttttgttttgtatgctcagtttatatgttcatttttctgttgctgatgtaacaaattatcacacatttggcttaaagcaacacaaattgtttatctcacagttctggaggtcaaaagtcaaaagtctgtcttactgggctaaaatcaaggtgtcaggagggctgtcttcccttctggaggttcaggggacaatctgttttcctgccttttccagattctagaggctgccttcattccttgacttgtgacttcttcctccatcttaaaagccagcagactcacatcttcaaatctctatctaactctctcttccgcctccatcttccacttcaagaatccttgtaatttcatggggcccacccagataatccaggataatttccttgttttaaggtcacatgattaacaatctaaattccatatgcacctttcttaccacttgccatgtaacataacacattcataggttctagggctttggatgtgaccatgtttggtggggtgttattctgagtactacactaggtaagtgaaactacagctttctcacaacctatgtgctagctgttcatgcttcctgttcagataataccaggtaaatgagagaagagaaacatccgtgggtaaacaattataatttagtacattattattctttaatttctatagtatttataataaagttcaataagaatttatctatgaggaagtggcttttctaaacaagtgtaaagcccccttgtttggaaaaatgtcagagagactgcatactttttcttcttgcccgcttttcccatgctggcctctgttgcagctcttctgaaatgtaatcattgctttatttctttatttatctctttcctaattttcttggaggttctttaagatgggggctatatactttaacttaccaacctattcaatgaatattcattaagtacctattatggctaactatttttctgaacatttgggatatataaattgataaaaaccaataaaaatttcacttctttaatggaggaaagacatcctatatagagggtgatgaatggaaataaactagaacaggtcaagaagaatcacaagtgccaggtttagggattgtttgtaactttaaataggttattagaataggccccattaggatggtgatatttgagtaaaggctttgatgtggtttgggtgtgtccccatccaaatctcatcttgaattgtagttcccataatccccacgtgtcgtgggagggaccctgtgggaggtaattgaatcatgggggttttacctccatgcttttctcttgataatgagtgagttcttgagatctgatagttttctaaggggcttttcctccttttactccacacttctccttcctgctgccatgtgaataatgatgtgtttgcttccccttccaccataattgtaagtttcctgaagcctccctagccatgctgaactgtgagtcatttataaatttcctctataaattacccagtcttgggtatttcttcatagcagcatgagaatggactaatacaggcttggaggagtttaaggagttagtcatggggtgtcagagtacgcttcattaggaagatgctatttgagtaaagactttgaggacttcaaggagttagtcatgtgggcaactacacaactgcattggaggcagagggaacatttactctaaagtccttaaggcaggaaaattccaagactgatcaagtaacagcaggagagcgtgtgcagacgccttgggccaagatgttgaatacatactgaagggagccaagggtgggaggtgatccgagagagtgatttttctggtgtggatcagggtggtagcaatgaacgcgatgtaaactcatcagattgtggatgcgctatacttggaagatagggcaagtaaggtttgtggacaggttggttgtgggatatgacagaaagaggttccaaggatgatttcaaggcttatagtttctctaattggaaggaggaagttgccatcaactgaaataaggaaggctatgatgagcaggtttggtagagaagatcaagagtttgtgttgggcctgttataaagttgagattctataagacttccaagggtagatggtgagaagacaatctccagatatatgaatctggagtttaggaaagaggtctggaatatgtgtaaatatgggagccatcagcacataatagatgctgagtgaacgaagagactgcctgagattatcaaatgaggcatagatggcttgagaatgagactgaggttggagtcctgggtcactctagcagagattagggtaagaagggaaaccaaccaaagagagtaagctggagccctctgcaccctttttgacagcagtaggtagtagatgtttatttagtggataaatgcccaaagaggaggtaaagtagcaaatgacaaaggggaattttatctgtctatgtagaataaattaaaaggtgaaaaacagaatcaactgtatttatctcatcagtgaatgggtaggaagcaagtgatggaaattaacataaaagtagatctgaggccgggcgcggtggctcacgcctgtaatcccagcactttgggaggctgaggcgggcggatctcgaggtcaggagttcgagaccacggtgaaaccccgtctctactaaaaatacaaaaaattagctgggcgcagtggcgggcaactgtagtcccagctactcgggaggctgaggcgggagaacggcatgaacccgggaggcggagcttgcagtgagccgagattgtgccactgcactccagcctgggtgacagagtgagactctgtctcaaaaaaaaaaaaaaaaaaaaaaaaaaagatctgttcctttttactctataaatatatttgtttataaaaataaccgttaattttaataagttaaagtgtttttttcttatgcaattacttctttttaatcttcatgatgcttaatgtgctggtgtggctaattctttgaaaaagtatgtaaaaaaatcccttctctacagagatgaatctagttcttcagattggttattcctatactttttatttgtttttgtttttgtttcagagacagggtcttgctctgttgccctggctggggtgtaatcacagctcactgcagtctcgacctcctgggctcaaggaatcctcctgcctcagtctcctgaatagctgggactacaggggcacactaccacactcagctaatttatttattttttgaagagatgaggtcttgctatgttgcccaggctggtctcgaacttctgggctcaagcaatccccctgcttaggcatcccaaattgttgggattacaggtgtgagccacccatgcttgaccatgtgaatatgaatatactggagaatagcaacactaagtagttgaaactcattttagaaattaccccatgaacatatctaaattcttcataatgagtcatagaagaatttctaaagtcaacttggtaaaatgtactgatgattttcattgaaaaagcatgattttgctttcatatatttaataatttgtagaactttcaactttcactgtggtcttaactggtattaaaggtgatttggaaattgtattgagcatgtatcttgctatagtataaaagaagtagacattttccttaagaactttatattctaggttaaacagttaaaacacttatataaatatacatataaacagtttagttgagaaaatataagatgatgtaattgcaggtctgtttgactcccacctatctcttttgagagaagaatttataaaagaatagactgaaaaagtggcaataactataaacttgcattttgacaggaagaagaatagaaaaggaagcagaatcagctgccttgatatggatacaagttctacaaataggacagccactatgcttgaatagtagtagttcacatacttcacgaagtaaattaaatgtgattatattgggcctgacctgttggtgagaagtggatgtctcagcgtggggaggtgtgtaagcttgctcaggaccaaaaagagccctaggtagtgaaatctttgtgaggggttggaacctgaataggaaatagcatttaacaatgctcatcttaaaaccgaaaacctcagtttttttatgagtatgttaagaatctctgaagatacaacctgggttggacgattacccaagatctgttacatatttaacatcagggaagttatgcaaagcttattattgtttcttgtgtttattttgggtgctgaccttcagaaaggccttagctaatctccaggtcaaagcctatagtgaccacccttgctgccgctgcatgccacacctccctctctgtgctatcttgctgcatttagggactttgttgtcatagttcctctcttactgcaaagggattccaaagctcttgaaaaataggaagtagctcatccttttctatgggctgaggggagcagtccttgatttacgataagaaaattctataatctttggacctttgatagaggtgacaaatacagagatctttcttggaatataatttgtccaaaactattttgagaaagcacacaaggcattaacatttacatttccaattaaagcatagggaaactgtttacaacaaggggacagaagttgatgctgttgtttattgtgttatatgctggttatagaccctcgttttacagttatttctctaaaatgcagtaaaaaaaaaaaagaatgcctagcaacatagcaacctctatgaaatgaggcatatgctgtttctaagactcacaatatgtttttctgaactgtttgctcataaacatgtttattgtaggtgctgcttgggcagggacggctttcctgtagaaatcctctcttgaatacactaggttctggttcctcttgtggaagaatgaagctctttttgactgccttggaaaatttgatactttcaggtatttatgacataatcaatggctgatatgtgtcttcaggatttatgactgtcctgtcataaattgccgtagtttcagagtgcatacaacatcactgtctttttattactgttattattggagacaggctgtcactgtgttgcccaggctggagggcagtggcgaggtcttggcttattgtaacctcctccttgccagctcaagccatcctcccaccttagactctcgagtaggtgggactataggagtgtgccaccatgccttgctaattttttaaaaaacatttttgtagaaatgaggttttaccatgttgcccaggctggtctcgaactcctgagctcaagggacccacccacctcagcctcctaaagtactgggattacaggtgtaaaccattgtgcccagcccactctgtcttttgaggtggtgggaaggtgagatgtagtgacacagatattctgtgtaccatagtgataccttatttatgaatcatcttgctctctctcttgaagtctctctatgctagaaacatcatctgatgtggtattcgacacgggttcaccttctggttttgtcactaaatgctttatgactttgatctcagcccttctctgtgtctagagaattgttaaattactaaattaaaatgaatttttgagagtcttttgatgtcacaaaatgtaatagctgctgagtgcccaagtatatatcaatttttctttagtgaagaagatgcagaagtggtaaaggagaggctgcttttggagagggcagagtgagaggagatggaagtttggaaatatgtcttataaggaaggccaatgaggaggcaatcattctgtaacatgtacttgtgatctagtaaagcttgtgttttgtatagaaggctatgtaggcttttatgactgggaacgtgtgaaaataatgacctagagccaatggggcatagggacatttgcggcatctaacccaggtctttttcattcccaggctagggggctacaattctcttctgaaagttacttggcatgatcatcttgctgttcttaaagcaaaatagcccaaattttgttgaagaaatgttttagagaaatgattgcctcatatttctaacaccactcttggttatttgtttactaaatagctttttattgggggaaaagtgtatggaaatttaagttggggaaattacttgggagaacttcttaatgtattagtctgttcttgcactgctataaagaattacttgaaactgagtaatttacgaagcaaagaggtttaattgactcacagttctgcaggctgtacaggaagcatggttggggagccctcaggaaacttacaagcatggcagaaggatgaagaggaagcaagcaccttcttcacattggcagagcaggaggaagagagtaaaaggagaagtgctacacacttttatttatttatttttttgaggcagagtctcactctgtcacccaggctggagtgcagtggtgcgattttggctcgctgcaccctctgcctctcaggttcaagtgattcttatgcctcagcctcccgagtaggtgggattagaggcatgcaccaccacgctaggctactgtttatatttttagtaaatacggggttttgccctgttggcgaggctgatctcaaactcctggccttaagtgatctgcctgcagtggcctcccaaagtgctgggattgcaagcgtgagccaccatgctcggcctacacacttttaaatcttttaaataaccagatctcatgagaactcactcactatcacaagaacaacaagggggaaatccacttccatgacccaatcacttcccaccagatccctgtcccaacattggggattacaattcaacatgagatttgggtagggacacagagccaaaccatattactgaggaacaacttaatgtagatagtttctgtgtatgtgtgagaataaagttttcttataaaccattctattttttaagttcaactattttatcttccttaaagataggggggttgaaagttgattttatagtttgagctcttgttatttttcaaccattagccaataaatataagtggcaattatttaagaagaataacataataatcaaatatgagaaatataagaagcttagaattgtggagttggaagggacaagtcacctcaatttatagtcagcatttatctaattgttctgccccccttaactgtaaaatggcaaaagtaatacttgatccataaatttcttttaaggattaaaagataatggattaaaagataatgtatacattcaaaaatattttttaagtgttttgtttgtttggtttgttttttcaagacaaagtcttactctgtcgcccaggctggagtgcagtggtgctatcttggctcactgcaacctccgcctcactggttcaagcattctcctccctcagcctcccaagtagctgggattacaggcatgtgccatcatgtccagctaatttttgcatttttaatagagacagggtttcaccatgttggccaggctggtctcgaactcctgacgtcaagtgatctgcctgccttggtctcccaaagtgctgggattacaggcgtgagccacagcacttggtctattgagtgtttagtatgtgccaaggcatatgctggttcagaggatatatctgtgtactagaaagaagatcctggctttactaactaggagggaaaaaaactttacccggtgatgacaaaggtgataagtacttccacagtgctcactgggacaaagtgtcagaccttacacagtacctgatactaggggagaaagagggatggacctgatgtgtcttgggtgtaaagtatacccattatataatcctaacagcaattctgtaaacctggtcttattttccttccttttacagatgagcaaacttgtgttcttgtaggtctgtgtcaagtaatgtttgttaaataagttaatgtgtaaatggaaacctgagcagttgtgcaacatgcccaaattcttcagcaagttagtgacagctgggaccagagctgtttctgacttcagcccaggggtcctttcattattctacactgcctctcagagtgtgcataggtgtgtgtgtgtatgcatgggagataggaaagttgcagtcttatatatgctacacttatcaatataaaaattatttcacaaaacacaaataatagtgaagtcagggctcctagtttaatccattttaattcctatcactagttacaggtatatttaattatccagatacgttgactttgtgctgtggatttagtgtactaaataacaggatccaaatctgtgaagttttctttttctggaaaactactggctctgaagcaatttaagccagaattcaaggccattcatccaaaatttaaggtgttctgaaatagaaggtgtatatatcactttacttaatgtgtgggttgtgtgggagacttttctttgcaaattgaatcattggagaccaatgatcctataactgcatttgaaatccttcagctggcaaacctttggtagttttaatttctttctcaaagaaaacatctgttataggtgtctgtagtctagttgtgtgtgggctaccatttcaattagtaaagctataatgacagtcttgggattttgtagaaaccctagtaatagatagaagtgaacatttctaatcctttattatgatcccgttatcaatttcaagtcagtttcttccctatgccatctatccaccaactcccagctgtcttgaaagaacatatataatatttttctaactttagggaatttcttttaagtttgagggcctctttctttttgctaggaagggaagccgggtcaggaaagcagaggagttagttttggagggccctccttttgtgcatcatttagttgcagacctaagcaatgtctttaatcccaaggaaatgatacaacactcctggagtcttccacggttttcagaaggtgagtattcactaacagtacctaactctgtcccttctgtaatttatgtggactctaaacattgctgtaaagtactgctggagaaatacaagacttgtacatttttcttttcttttcttctttccttccttccttccttctctttctctctttctttcttttttttttttgatggagtttcactctttgttgcccaggctggagtacagtggcacttaaaagtcaacctgaatcgcatttttctccagtctgcaatagtttgcccaaataattacagttttaagtcttttaaatggttactagtccttccagcacagaaaggtgatgcagccccaaataatgtgtatgtcggtactgtcactacagtgctttgggtcgaccaatctcatcctgacttctgatctggagtctactgtcatagaaaggtataatatgcttataatttttctcccccaatatttctttgcttctctgtggcagtatttctcccccaaaacacttagagatgtttgattttatccttgcagctgttataaggcagacaagctcgagctgacacacacagtttctctcatgacaaggaccaattgtgatttatgaccatttacaggatgctagtgatgtggggaagggtgtgtttttagctagcaaggctatgtcctttcacttggaaataaacaacatgttaaaaatatgtagcagggttaaaaagaggaagcttcactgtaattttcgtttagtgaagagcccttaggctaactttctataatgttcagctaatgtgtttatatcttcaaatcatcttaacaaatatttattgactgcctgcttcttgcaaggtgttatgctggctgaaatgaaagttttcatgaaaattctaatgtatagaattaggaagttagaaagcggggttattagcatgggtctttgtctgctttagttgaatagaacctgttatgaagcaatacattttcctccaaaaatttggcttctttagcaagcagcatatcaactaaagatgaaagaaagaagtggaaacatttattcacttgtaatgttaatataaatctttgttttcatcagaaattcctgaaaagctagattataatatgttacagtacaaccttgggtttggcttttagcaccaaggttaaacaaagatttatgaacacaaaagatgctgtgaaagctcagattcctgctaaaccttgaatgtcctatagtcctctaaatggtcctaaatgtggaaaaatcagtcttctcattggttaggacccactgacttccgtcattgtaattactgtgatataacctgtagggtatgagtgattaaataatttaatatcactgggagagttacttattatgtgttttatttgtatatttgcaagcagttcttcatttctcatgacagttcttgcattcatcatttactaaaatggggttctgagttaataacatttttttcctcattataaaaattctcagaacaagtcaagatctaattagacatcttcaatttattaaatcagacctctttacagagcccttttagaagcccaggtaacacttgttgttttaaatcactggcccaacatagtcacatgaatataccttgatgcaaagaagacggtgaagatgtaattttttagcctttgcatattaaaaaaaatcagaattctgatagtaagaaaaacatattgtttagttgcccaagttgtgtctttttctccacctctgatttcttcccaatactttgatgaagtactctgatgaagtactcccaatactctggcgattttctttttcttacccactataaagtgtggtgtttgcacttcatgcctgagtctttctttctgagaagaggctcctgcaagtctttggcagctttcaactacattaattttacaggtccatccttgaagcaaaactttaaaaaggtattttatgcttttttccttcctttttttaaaaaaaaaatttttcaccttttaattgtcagttctaattatctgtgcaaactgattcaggcagaaacatacaattctgagagaaaaagggaccctgggactgacaacctaggtttactgagtgggagaggcagaggtgcttcccaaataaaaactgtggctgttaccagaagaagggaacagggatgctggaaaaagaaaggacagacatccagttctggaaggtttatttggcttttattcataaaaatacgaaaacctttccttggttttctgctcttaatcttcctttaaatacatcaactagacatagtcgatataggtggttcttgtaagataaaacctccttggccccatgcaggtactctcctgatatttatacacagaattgcccatgtctcttaaaaaagagaacatctgatttgcctttaagaaaaatgtgcaggatggggtgggaatgagggtgggtgagggctttacatttcatgcagttgcagactttttggaggcagcttttactctctgggtcatattttaattcctgatcctgaagtggaggggaatcctgatgttagtgtctgggtggtattcttgatagacttttagttgaataagtaaggaaggatgcttacatgaacaaaccttattcagtgtcccagtttctgagcagcccaaggcaccaaagcctaacctaggatgaggatggtttgtgtggagctggtgaaactacagctcccgatctcatccaagattgttgttttccatttgctgctgaacagctgtttgtttggctttccagcggcatgaatatgcccacataatcacaaactcctagatattgaggcatcttaatgagaacatagcctgattttggaaggaatggaatgaaggaggccaagtgaattgcatcagggtgcctggtagaaaaactggcattagaacctcgattctatgctcactgtccgtgctctgctccagtacatgaaatttgtcagagaaaatgagatgaagcaccatggtttcctatgccctccctgtttgttcctggtacttaaccaacctaaaatctactcatggatctgtcaggttttagatttagtaacaggctcattgactatggaaataattgggtgggggctgaggtctttatggtagattcaagtaactagagcaagagtagatgggttattgtggtagaatgagggacatttgctagtttaaatcacatttctgcagtttgtggttggacttggagcttctttttctctgtagcttagtagcagatgcgcttttcgctgctggagcaaaactacctacagtagtgtgaatcagcaagtagggagtattattagtcatgtgaattcagatacttcctattgccaaaggcttgatatattcatatcttacattttatcttctctgtgacgattcattacatgtagtgagagcatatacttagtcttctgtgtggctcaactgggggcacatttggtctagtccaagtaattatatgtaacgtaaaattacatacagcacagtcatcaaagaagctgtccttccttcccctatcactaagatctagggtgactctggagtgccactgtgtgaacatttctcactcttgtgagcatgtttctaaatcccaaatcaatctgacaaaggattttctgtgaatttcttgttaatttcttgacataaaagctcttatgaacatacatattccgaacttaattctttgtttgagtcaaaatcatttttattcaagagggaacaattatattaatctagatttgcctggtaaatccataacatacagacctgaagttcaagcagaacccgaggtaatgtgagccctgggtaaggtatagtaaggatggagaggtaggtaaagaaaggcgagaatgattcatttattgagaaagatgagcaaggtggtcaaatagatttgcttctcaacaaagcgtgtagtttaagcacttagttttggtttcttttgaagctgccttccctttttcccatctctctattccaacataacagaaaaagaaggaaaaaaaatcaatacaaaacaaccatttacttatttcccagagtaatgcttctcaaactttagcaatgtgcatgcaaatcacctggcaatcttgtaaagtgcagattctgattcagtagtggtcaggcagtgattctcaaagagtgttccttggagcagccttgttggaacaactgtgagcttattagaactgtaaatttatgagccccacctaacctattgagttacaattttattagatgggcccaaaaagtgttttaggaagcttaccaggtgattcttattcacctgaaagtttgagaatcactgacatagaggagattctctggagtttttctcaggactctggtattttctactgtcactgggcttacagtatacagttgatctttagcagtggaaacagttggacagagatctttatttaggctcctgaatggctgtcggcatcttgaaagttgactggcttcattaaagtctctatttcttggtcctttgacatctattatgataaccctgatactttctaaagcagacatgccacttcatggaatcacgcacctcatggaattccatgcacttcatggattcatgcacgttagcacagctagacacctttatgtggcaattgggtaatacttactttaaaagatagaataaaggaaaaactacctaaaatttcccataacatttttttttttttgcagacttttcaggggtatggatactatatgggctttatatcttcatatcagcttagtcctagttaattgttattttcaatcatattaatggccattggtcattgctagccagtatctatgactggctggttctaatggctacaagcatgcttagcagtgccctcatgaatgttgctattattgttgaaggaggaaaacattttaataattggaattggattttctcagtattcagtattgcaaaaggtggatgtaacttcttatgatgtctcaacagctattactttattttttaatttatttttaaaaatcttattgtcacaccccatgattctgcaacagctataattttaatttctgaaagttttgatgatttcctccaaggctatagctggagaaatgtacattgtctattattagtaacatttctcaaattgtttacaaggcctgcagtatagatgggctgagactgtgtttatgctttttcattgagaaattttggtcttgcagaaggaatccatttgttctgtgaatctctataaagcaaagagaagagttcaaaatttataagggagcccaacaagtgttccaaaaaaggctatttaggcacaacatttaggtgcttatctagtatgttgtttctatcaatacatagcttaaatataaatagatctaagaaccttagttaagacgaaagggtatagcataccatgctataaaatctgtcatacagaatacacataaagtgtctgctgtaattttgtaatctttccaaaagcaatatactgtgtctacagccctcatttacaacttatagaaatttactcattttatgcagaaaattggaaaggagcagatgtttattcctaagctagaattttgaaggccaacaattaaaataaacatgtctctgccaaaacttgaactaaattgaaaaatttagcatataaattaaagctcacttaaaactaaatttatcaaggaaatacatttgttttgcattgctggtttcaattattctgaaaggacttttatttttatggaacactgaagatttttaaaagtttcaaacaatttattggacaattgcaccatttaaaatgagttacaaatgtcttgcttaaatgtatgagctattagcacatagttgatgaccttatagagagacattaaagcaaccatatcctcaagtttatgtctatattcccaggggagtacaagaaactggtctgtagacctgaaatagataaagctgtgggcagcattctcttctattcatttgttcctttggtcaggaatctgaattttgagacatattcaataaattatgcatactcaaatatttgtgctcttagcttattgccacagaggaaaagagattatttcctactttttagtatctctctgcttttgtctgatttgtacaatgttgcctaattaatttttcttaaacactttgccctccacacattttgcctaaaaccttcattggctcttgtaagatgtgctagcattctagggtctcagtttactgttgctaccctacttaaatgaatctccaatgcttcctaattgttacttcttggcttcaaccaatccaatgagtttcctttctctgacacatatcagatttatgcaaagtagtttcttggcttaagttgccctatatttctacaaaggtctagtcagatggtcagatgtgactatctctacatatgggtctgaaatctagtttaggaattctatgctgtgaatgttttagcttaaaactctaaaatttaactagttttttgaattctctctattatattacatgcttctggaataaatataaacacaatgaaatcctttcttgaaaatttaggaagatgttatacacaatataaataagttgtaagatagtgatttctactagacagttaaggtattaaggactatttgtccttgtattaaatggacccaggctatgcctttctagtgtttttgtatactctgattttttagtggctttccattaaatcctgaaagctcactactaagactcatgacattttttggggggttagaaaaattactatgattcagggctgggcgcggtggctcatgcctgtaatcccagcactttgggaggctgaggcaggcggatcatgaggtcaggagatcgagaccatcctggctaacacggtgaaaacccgtctctactaaaaatacaaaaaattagccaggcgtggtggcgggcgcctgtagtcccagctactcgggaggctgaggcaggagaatggcgtgaacctgggaggtggagcttgcagtgagccgagatagtgccactgcactccagcctgggcgacagagtgagactccgtctaaaacgacttgcagcacatgaacttacttactatgattctctctctcaaataaaattctggtgacttttctttaactcaccaaaagtagatacatacatatttataattcattgtttgaagaaaagccttaagatattttgaaataaaattctacacacattacacagaacttgtagctacatgaggagagcaaggtttttttgttttgttttgttttgtttttgagacggagtctctgtctgttgccaggctggagtgcagtggcgcgatctcagctgactgcaacctctgccccgccgggttcaagcgattctcctgcctcagccttccgagtagctggaagtacaggcacacgccaccacacccagctagttttttattttaatttgtatttttagtagagttggggtttcatcataatggccaggatggtctcaatctcttgaccttgtgatctgcctgcctcagcctcccaaagtgctgggattacaggcgtgagccaccgcgccccagcctgtttttgtttttattttgtaaaacggccttctccacgctgaaactctctctcttttgctctttcatctgtcatctcctccccactcccacaccccacactcctttacccaatcttgccactgcaggacaagagataggatgaaagttggaaaataataatttatggagaaagcctgtgttccttgctttatgaaagtaaattgtagataattaatgttgtgacaagatgattctattttgatgaataaaatcattgaaaagctatcaagccccactgtttctctgctgagagaactttttttcctctctgttctgcattcctattcttggctttcttcccaattagtctctgctaaagagtgataattggggagataggattttcacctaccttgtgaacagtaaaaatacccatttttccaccactgaagctatgtgtattaatattctatgctttcagaaagaaaatcccacactactgtgattcctgcttaaaaaaggaggtaatctaatgcccaagtaaaaacaattttatggtacttttatgagcttctgggaacaatggccatgtgatgttcagttgcgtgtttcatgtctgatgactgagttcacgtacgtcttagaggctaaatttggtttaaaatatcttacatcttctcaaattccttataacaagagcagtaaattaaaattaaatttcgaccttaaatggattgcatgttttccatttgtaatatattcgtatggttcaaaaatctgaaagagtaaatgagtacatagtaagagatttccttcctacatccccatcttcccagctccttttactccccctcccttctgcatgaaaactactgttactagttttttatgtgtccttccagagttttttctgcatatacaaacctaaaataaacatagattcttattctcctactttttacaaaaaatgtagcacattttataaatattttgcctcttgatttttttcttgcttaacataatatagagttatttccatatatacatacatagggacatttcttaatttttttatagctgcatatcatttccttgcactgaagtaccataatatatgtatatttcacaattacctgattcatgtatatttgactagtttcaaatcttttgatattataaacaatactgcaaagaatattatatatgcataattttatacagtaggataatttcccagtattggaattgctaggttagagtacaagtttatgaatgttgatcagcattgtcaaattgcccttgtatagggattgtgcttagttcggctcttaccaggcttatatgagattgttcctttttcctcagccttaccaatagagcatgttgtcagcctttggcattttgccaatgtgataaatacaaaataatacattagcaaatttttaacctgtgcttttcttattatgagtgaagtaacatattttcatatatttgagtgatgttcctctatacatgatttgtatcttttatttttttcaacattcaaatattttattgttgatctttttattatttatttctataggcttcatctaaattgcaccttttcctgtgatataaagtaaaaaatgtttcagaattatatcatttgtattttgactctgagtatcatctttttttctatttttgtttttttgtttgttattttctgaagaattggttgaatttttctagttcatttttcttcgtggcttctggatttttagtcataattagaaaaggctttccccttccaagattataaaggaaatctcctgggattttttgtacttttgtattatctttaatatcacataaatctctgattcatctggaattggcttgtagtaagaagtttattttttctttatatgacttaattattgaattgactatctttttcccactgatgtaagatattacccttattatacactaaattcttctctatgttgagcaatagttttgaattttctgttcaatctctttggtctgtttatttatgtgccagtattcagggactatatgttttaacatctagaatttctaaactacctttaataactgaaattgctaagctgttttcctatttaaaagtttttctgaatattcttttcttcttttttctttataaacttccagattaacttgttttattcaaacagctggtgttttaaaaatagaattttattacattttcaaattaaattgctgtctttatgatctcgaaatttattctcaaaattatgatattactttttcagttgtgtaattccctttgtttcctctaatggtgctttaaatcatcatataaatcttgcacatcaactttatcagctttatctcttggtattctatctttttcatcactgttgttagtgatttctatatgttgattttgaattctattttactcatcttttattgcttgtagttgtttttcagttaattatcttttatcttccaggtgtataatcatagcttctgtagtaaataattcctttgttttcctctttccaaatttgtatagatttaatttggttgtaactcgtctaatcgctttggattgtacctagagatcagctttaaattttatcagtgatcatctttttcttgtttctgacttctgggattctaaaattttgtcataaagcatgataatggtttttggtctcggttggctgtattttattacgttaatgaagtatccatctgtacagtcctagagttgtagctggacctgtgaacaccaccttaagacacgcatttctcagccccgcttgtatttaagccttacttgtatcacctagtgattcatgtgtgcccatgttcttgccattgtaacgtaagtaaaagtgatacttgccatttcttccacatcctttcttttcccttcttgctggcaggaaaccagaagtgatggcaacccagcctcaactatgtaaaggacaacaaggccttcagggatggctgaccatgagatggagggaacctgggtcccagaatcacttcgtggaacagactactcccctgaacaacaacttccgattattacttgagaaagaaaaataaacataattgtttttttttttttttttgagacggagtctcgctctggcgcccaggctggagtgcagtggcgggatctcggctcactgcaagctccgcctcccgggttcacgccattctcctgcctcagcctcccaagtagctgggactacaggcgcccgccaccatgcccggctaattttttgtatttttagtagagactgggtttcaccgttttagccgggatggtctggaactcctgacctcagctaatccgcccgcctcagcatcccaaagtgctgggattacaggagtgagccaccgcgcccggccaacataattgtttttaaagccattttattgttgagttttttgttacacaaagccctttattaccatgactccacatttatagttgacccttgaacaatggggttagagggttaggggcaccaaaccccagtgctgttgaaaatctgcatataatttttgactcaccaaaaacttaagtactaatagtctacttttgactggaagccatactgataacctaaatagccaatcaacacacatatttcatgtattcatgacacacgtttttcttaaatttttctatatttctagtctgcacagcaaatctccaagcaatttttatgtatatttattttttaaaatctgcataaaagtggatttttggagttcagacccatgttgttcaaggttcaactgtagtccttttttttttaggtgattttttatttaatcaaatgatttatttttttttaatcaagtgatttttttttttggtcaaaaacctttttcatctatggaaattatcttgtgctgtatctctagatatattcatataaattatattaatggttttacaatatttgaccattcttgctttccctggaataagtcacatttcatataacgaattatttgttcaagtgcttctgggaatgtttcaccgatattcatacctaagattcgtcagctgtttttgtttcctgcagtctttataaagttttgatattagtgttactcttttttgtagaggaaagaataattttttaaaatttttccttgttctggggctattttaaaatgctggaattcactgttctttaaaaatgtggtagaattttcctagaaaacttccaaggccagaggtttcagagtattaataattggcacatttctctaattcatttgttgaaatcagattatttagagtttctatatcctttggggtcagttttggtgaattatacattactagaaaattacatatctcatccagattaaatttattttggcatagagctgaataaaatagtctcttttggcttttttatttttctttgtttttgtggctttttaaattcttattttcatgtttgtagtttgttcatatttccttgaatagtttagctgtgcttcatacattaaatatttttcttaaaaaataatttttaaaatgtatttattctattttttccctaactccataaatattaactaccctcttctccttttccattgattttttgttcttttctataaatttcattcagaaactcaatttccttattttctttattcttttaaattttttaataaaaattaaatgctctgagttttcctttgagcagtgctttagctatagctcatgaattcaggtatgatgtttccattaatattatatattcagatatatcagattgcataactctttgaagagggaattgttttggagggggttttaaaattaccatgagaaaatttttatttttctccagttttatcaatttctatatttaatgtatcatattaagagtatgttttcgctgttatttctagaatttgcctatttctgaaattttctttatagcctcatatgttatcaattttaataaatattccataaatccataaatatggattgttgaaaagaagataggtctttttatttctaatataaagtatttttggtatatcaaacatccataacacattaatgatgctactctattctcatagcttgagagaagagaattactctcttctcactagtgtgtttctgtctcttatttcctgtaatttcaggtttgtgaacattttgctattcataacaattttttgtgaattacactctcttgagttatacaatgttgttttttgcatcattttgggcctaaattcttgcttgtctaatatgaaaaataagaccatctacttggattcttttctgttttgccagtatatctttttccacattttaattttaattattgtgaatcagtttgttctagctattcttttaaacagtattgagcttggttttactttctcattcaatctaaatatctttgattttaacaagtaaatttaattgattgatactgatatagcaggtatgtttgttctgagtgctgccatatgttaaattttttgctttcatgtttgctttatgttctttaacagtctttcattatgttgtctgtgtacttccctttgttttaagtatacttctgatatgtgtgaaggtgacatatttattctattggctatctttataatttagttgttaaccttttgtaaactatgtttgtacttctatcagtttttttgatctgctttaatgatattacttgatttccaggaattttagtaaaataatcaacaaacattttcaacttcctaatttcttttcccctccttcgcatttttaaaaattttaccagttctgcttggcagagcacataatattaacattcttttttggtcatcccaaccctcaaatcttttctattatttccccagtcatatttatttggctgaagaccacctactactgtcgtcaagaaagattaaatcatttttgtaagtaaaagctgtttgttgcctttattcctaaaggacaacttgactcaaactttctttttctgaggatcttgtagatggtgctgttaatacatgttttatggtgttaaatgcaactgtagagaaatctgattttcatgcttataagtaatttactgtttttgctggactaccttacatattctttctttaccatttgaagttcaataactgtctgggttgtctacactgggttagtttttccttgcctccagtgtacctttcaatatgtatagtattattttatttcaaagacttttggggagcttatatctttaagttgtctttatgtctctctgtttttcctttttaagtactctgtcttcttctgttaaggctgctatcacaaattatcataatctaagtggcttatgaacaacagaaatttatttcttacagttctggaggctgagaagtctaagatcaaggtactggcagatctgtgtctggtgagggctgcttcctggttcatagattctgtcttttcactgtatcctcacgtaatggaaggagcaaagaaaccttcgggttctcttttatgagggcggtagtcccatgcttaaaggctctgcccacatgacctaatcacctcccaaaggtcccatctcctaataccatcaccttggaagttagggtttaacataggaattttagagggacataaatagcacactccaaatacgtttgttgtatctactttgcctgtcttctgtatccgtcatctagtctctcattcttttcaagtctttattttcattttattttgttctcctttttttaattagcctttatgttccttattctattttctgtagcttttttttatcatttctgtgatttcacgctattatttcttgagctctgacaggttatatttgagcatttcctcttgacttcctgtttcttcttcatgatcttttttttttttttttttttttttttttgtgatggagtctcactctgacacccaggctggagtacagtggtgcattctcagcagctcactgcaacctctgcctcccaggttcaagcgattctcctgcctcagcctcccaagtagctgggactataggcacgtgccaccacatccggctaattttttgtatttttagtagagaaggggtttcaccatgttagccatgatggtctcgatctcctgaccttgtaatccacctgcctcggcctcccaaagtgctgggattacaggtgtgagccactgcgcccagcccatgatctttcttttaaaggcagttgcttcatttattttacaaaactaatgacaaaaattttggttagacttttcattctgtcattgaagaaattcttgtgctctttgtctgttggtaagtgttactgctcttttttttcttatagtaaccgcatatcagtgttgttccatctcctttgctaatgctcaatactgaatgaattgggtcttcatgccttaggtatattagcagaggtgtttgtgaggtgggaagatctaggcagtcttctaaacttcacatctgaaaggtgttctcattaggtggttccacagagacagtgtacttgctgctaatatggccccttcttcaatctgtctgtctattatgaatcaatcaatcaatcaatcaatcagtcatctctctgtccatccatccacccatccatccatccatccatccatccatccatccatccatccttctttcttttctgcctctctagtctaaactgtatttaggaggcttcagcagccagccctactcactgccatactccttctaaatttttttttttttttttttttttttgagacggagtctcgctttgtcgcccaggatggagtgcagtggtgggatctccactcactgcaggctccacctcccgggttcacgccattctcctgcctcagcctcccgagtagctgggactacaggcgcccaccaccaagcccggctaattttttgtatttttagtgtagacggggtttcactgtgttagtcaggatggtctcgatctcctgacctcgtgatccgccggcctcggcctcccaaagtgctgggattacaggtatgagccaccacgcctggccactccttctaatttttaacacatggtgaggtgttgcatattggtatattctactgttattgtaacttcttttccatggtggtgtatttttgttggtattttctgagaactgttaatggtaagctacttaacctcactcttcacttcattttctccttaatttatttccttttgcttctatcagacctttgccctattgacaggatagttgagtataccaaaaatacaattttagcattgcagggtgccacacatgttgagaaaatatttttgccagtgtctttggaaatttgcccttgaagaaccaactattctctgtttcttttttttttttttttttttttttttttttttttttttttttttttttttgagacggagttttgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggcctttctctgtttctttataatgatttttctgtacaatatcagttgcctttgggagactatgtatgcttggaagtgtgaacattatatctgttctaacttttatgattaaggagtttatttttttcctcatttttttcttttctttgttgcttttgtgtaatacccagcaagtggaaggttatttattctgatgccttgtttgtactgtaatttgaaaactgacattttgggataattttatttattttattaagattttttttgtattggtggtcatgtatgtagtttaaaatgaagtgtggatttttaggctataaaattagccagggtttagaatggtaaggtggataaagcacatttactttttttcctccatttttccttttgaatcctgatgagtattatctagttttcatttttggtaagttctccacattcatggactgctttgttactattctgaccataaaatgcttgaatttagagttctatgtgagaaaagtgatccttgttgtgctgttatgactaagcatattgtataccacagttaggaaataaaaagcactttgcttcctgagataaatcatctatatgcatctatccatgtatctatcaattcatctatctatctgtctatcaccttatctagtactattccctcaaattaaggaaggcttgagctctttcttataagttgctaactctctcattgaaataattcattccctgaattttgcaaaactgacatccataaatttgtgatgacccttgaagatatgattaaaaaatgaagaaactgttctaccatgaataggctaattgtaactttagtagccttgtgatttttttttctctaaatacccgctgtgtccatttgtcaaagatccttgcaaatatttaaattttgcatataaaaaatacctttcaaagaatatttttatgtctgcatttttcttttaccagtgacatttcactgatcatagaaatgaaacccagagttattgctatatttatgaaaggatgaatgtataattgattaaggagatctatttaatataaagcttataattagggtcatgataaagtcttgaattgtaaatatatgttgtatttattgaatagaatgcaattagagaatacaaacctataaaatatgtaatattagaggtggaaacaagacaaagtttctttgacaaaaaggtgcatgtacatagatttaggtcagagattgactaatgcttaaaaataaagaaaaaatgaatcaatttaattgagataaatgatccatgattaggataagagaaagtctagctattcaattcagagttcacttgaatgcatgggctgctgtcaagtttttaataaaagtacagagcagcttcctaacagaggtatgaataataagtttatatgtctctgaaacaatgttaatataattgaatcaaagaaataattaaatgtataatagtcttctatttaaatttgttcttaacagtgcaatttcttatttaaattctgtattatgaatttaattatttttgtcaagattttaaaaaatcattattataaccagttggcaccataattacttttagggaaggaactgtgttgggtgcggggagcaaaacttggtaagtcacttgggattaaaggtgtgggactttgaggatagagcctccgtaacaggataagttattctacatgagaaaatgggaagtgtttattttgaactactatatggattgggattggaggctgaaggcagtcttctaggtatcaaagggcagggaggttttacctgacatatgaattattgtttcatgtaaatatagttgaaagtcatatatatttagaattttaaatacatagtttcaagacagtgcttttaattttttaagaaaatatgtgtcatttattttttccaaagctagtggaagtttctttgtgtcctaatagcaattgcgtgaatgaaatcgacatgaataatacttccagttagattttcataaactgacagatagtttcataaatacccaatatgtaatgatagtcagagggagaagctatattaagtgtgtatttcaggagagattgtcctctggagcatatactagcatcaggcagctgctttatggaaccacccaccaattcccttgggttgttgttattattgtttgttttttgtattttgtttagtttctagggaacataattttctttgtgtttctttttgcatgatgctgaccaagtcatgttcataaatcacatatgttgatatctacagtgctttcattggccttccaactcgagcatggcaaaatatgcttattttccttcagaagcgcatctttgtgttaactaggcattaacaatatgtgcttaatagcaattatcttatttctaaggatctcagagttggtttggcacattgcctcagtgctcttcaaacattatcagagaaggacaacataaacaataagatttacactgtaaaattagcctccacttacaaattcttttatcagccaatccttatcttaataacatatattaccttttattaaagtaaatatgtccctcagctctagcttttttctctgtatttttatgtacatttatggagttttactgaaatatttagaagactactgtctaaatacggttctaatttttaaaatgcataatctttagggtaaagtcttggagagtggcaagtttaatcaaacagtaacgctatcagagataaagatcataactcgcattaaattctataatttaaaataaactatgtctggtatgtattcagaaaatgtcagagctagaacatttagttcagtctctatttcatgggttaaagaaaagaaagcttagaacagtgaaaatacttcctcaaggtaatacttacagttcatggctgaagtggtaataaaagtcacaaccaactttttcctctctgctttcttttctttctgttctgtcattttaagtttcttaaaggaaaagcttagagaaaattaagtattgatgatagagcagatacaggattttcaccgggtgcagtggcttacgcctgtaatcctagcacactgggaggctgaggcaggtggatcacttgaggtcaggagtttgagacaagcctggccaatatggtgaaaccctgtgtctactaaaaaaacaaaaatttgctgagtgtgatggtgcacacctgtaatccctgctactcgggaggctgagccaggagaatcacttgaacccaggaggtggtggctgcagtgagccaagatggcactactgcactccagcctgggcgacagaatgagactccatctcgacattaaaaaaaaaaaaaaaaagaaaaacaaaaaaaggattgtgttaacatgggggcctgggtgagaagagaaaatttatttataggaggacatgtaggaagggcactgaagattactgtttaccattttgaattgtccctgctccagtcttacaaagtgggacatgcattgtgtttcttgggcatactcacttccctaagaataagctgtatcatccaatgctatttgcacagaactcacggctttatatttactgtcctaaaataagtgatttacaatcttttaaactttaaaacagtaaatttgattttcagcgatgcctttttttttgtcattttaaggccccctccaaagtgttgtaacctagctgaatgaaaaataagtggcatttttgttgttattgttggtgatgatacttttcatggcaatctttgagatacctaggaatattccaagtttttgaaaaatcatggttgggaattaccactctggaaacagattgccatggttactgtgttaatgctgtgattaatgcgtcttttagtcttgtatgtgtgtgtagatgtagacataattctatattctagtttggttaacatgtttgatctttttctatcagtcagagacataaaaatgtcttgactctcttaaaaacaagactgttcccattttttaacctaatggatatttgttgctgaggatcatttttttgtaaggagtgaaatacccagaaaactaaagtggtctagaagataactgctagttctacatttttttttttgtctgaagttgtgtttgaatttacttcctttcatcacttagtattaaaagaacagtgtgtcaattatagataagaattctacatcccctgtctttccctaagtacctgcttcgaaaaatgggtgcaactagactcagtagctagatgtggtatgtggaatgtggattcgttcgtatcaggcatgcttcttataggaatcctttaatgcactcagtcacccagagcagtcaaaggcctaagctgcttcatactttatagcagggcacagtcacttccataaatactgtgcactcccaagtaaatccagaatgtttgcaacaggatttgtgtaccatccccaattctctgttttcttcaataaagtctttgtacacaattgtttgattgtttttatctcttgatactcacaaataatgccactggagaaataaacctaagacatatccaactggatcactttatatacagagatataacatttcaacaacagaagcctttcttgttgaggggatgcacatttggaatactctcaaatgattattcgaaatcaagaaaaagagccaatgagaaacagcaaaacacaaatatctctaataaggaaaaatatttctgcaatgagatttttcttagatatatatgtgatgattaagagcatttgtttatattgtaggttcttgtcctaaacttacaatagtaagtgtagacaacactaattgttatggtaaaaggtgctacatgtgtgtatgtatgtatatgtgtatgtatatgtatacatatattatttggatattccagtcagtggtacttactgcccttggttaatgcataattgtcttgagaaaatgattatatgtatcagtgtgatctggctaaaacaactctctccaactgatcacctgattttgtttcatttccccgggtaatctggtaggtggccatttcttttctttctagtctatgttccctcctaaagataaaacttggtcaaacatctatttatggtaacctgtctttaagatagtttcaggcataccttcttcctttaatctcatttggttgatatgttagatcctttcctatcagccagagaaataaaaatgtcttcagtgtcttaaacaaaattgtttacattctttaattaaatggtcattttaaggagagaaatgctcagaaaattaaactgagtatagaaggtaactgctaattctacatttcttttctgaaattgtgtcttcatttgttttttaaaaatcatttagaagctgtgtagcccacagagaagttctcaagtttgtggaaaagaaataattaagtcccgaagttaggggtagaagagaatggagctttgttggtcaattctgacatcttagaacacctcagtaatgtggttctttgaaagcatcaaatcgctgcggttactttagaaaggtcatttttagaatgcttatactacttttcccccattttgaaggtcaactggggtttattttaagttagtattgatgtaaaagatggcacaccctcttctggggcataaatgcttgaggatgagccatagtcatgcatgacatgtgtcaagataagaaatggaaatttatctgcagagactaccatatgatgtatgtgtaaattttcagtccctgggattatgatttttttttttagtgaagacaaatgttttttgttagttagatcctgatttttggcatgatttagtaggagaaagaaggttttagtttagacatagcttttcttacatcttgtgtaaaattgtcagttatagggagggtaaacactgcactctggaaaggccttctggaatgtccttatttctgtgtgagtgtgatggaaaaaaataacttttaaaaaaatacatgtttaatgaaagatatttccaggttattccttctggattttaatttaacgcttgtttgtatctctatgatagcatgtatgaaaatgtattttaatgatttaattatctccccatattagatgatcttgctatctttatcatatgccctgtttatttttctattcctggtgataggtggagtgactgatacattgcaggtacataatatacatttttgagtagatatgtgtatgattaattgacattttgcaagcctttttttccaacttttaagttctggggtacatgtgcaggatgtgcaggtttgttacatacgtaaacatgtgtcacggtagattgctgcacagatcatcccatcacctaggtgttaagcccagcatccattagctattcttcctgatgctctccctcccacccctcaacagtgtgtgttgttttgacagaccccagtatgtgttgttcccaccacgtgtccatgtgttctcatcattcatctcccacttatgagtgagaacatgcaatatttggttttctgttcctgcattaggcaaaccgtttttttgtttgtttgtttgtttttgtttttgtttttaaagaaaaaagaaagacatgctatgaaatggccttggacctaattcaagaaacgaaagaaagtcagagatcaaggaagaaaggaacaatgcagagtttatggaagttagatgttaagatgacagctgagtatgcttcttttctcctcacccttgtttagccaggtgcttacttgacaatttgtaaattaaattattccttgaacaatattttgcacaggagtaaaggaatgcttcatggataaacagaggcaatacctggagctaatctttgtggataaatgtgtttattttgattcctgaagctgggatgcagaactgatagagggaagccagggggttttctctgctccaccaaataaatcacatatgactagaaattgcaaccagacagcaatctgtgaagcaagtgataggagctccaccgtctggtgcctgctgtggatgtctggcacccattggtaccagatttggtgtaagtggggcttctgtttaggaaactttgccaatttttttttcttgaaaagtggattttggctttgtttctgcattcttatatgggaataaaaaaatctcataattgcaaatgtgtttattatgccccaaacattagatctaggctattctttccataggatattgtaatcctgtgtgggtacatttgctgctgcatttgacacagtaaagttgtattaatgtttttcattctgctatcttttagaactaagataggcataattcctaatttatctgtgctcccccttatgcatacatttaggtagtcaaaccttgagagtttctatagaatatttttaaaacttacctttggtctgtcttatccttggaaatgttttcacgtttgagagcatcacctcctatcagatcattctgttccttgaccctctccctctgacaaatttcacatctttcttcgcaggaaaaaagaaactaaggctatatcatggctttcttcactcctcttcattctgatatgaacatttgaagcaagcattgatttttttcttccttcttcttacttttgccagaacccatgatgctgtttattctggtggggtgtgtgtgaaacgcatgttgcagttccatctctcttgaccttttctttgtttgctatgtatattgcatctcctcagttgtccaggttatcgcaagaaattgtgctggatttctactcgctcaccttctatttcttactaaatattccttgttgtatcataatccctctcaccagaattcctcctgtgtgaactcatagattacaatctacattgctgcaagagactaccaaattttccatctttctcaggtttctgcaccttcactcactcttatatctttccaaactttcctttccatctttcttaatgtcaaacctgattagtcattctcctgcttaaaatcttccaccgagttctcagggctttcaggttgaagttcaagctcattagtgtgacatacaaggctcttaggacctggtggtctcagcccctggctacttccctaaaacactgcccactcagaccagatctaactagttttagttccctatatcatggtatactactgcgattttccatgtgcgcttactttactcccaggtctctctatcctcttcctcttcatgtaactaatttcttcctggctctttgacactgggcatcagtgtcatgtccccagtgtctaatgtgatgtctttcatctgttctcttataggcttggatgcatctccttcctgtcatcttactagtattattgttcactgtccttccacggtggcacagagtccccagggtatatcatagtattgtttgcaaaggtctactaagagtaaatgagtaaatgaatctaataattttttattgctttaagtgctctgtattttaattcactgcctatcaagccttgctctctttgaattatatttatgtctaaatgttcatgatagcatcagattgaattaattgtagccttatatattgactctcaaacatgaccaagactgttattgttgactctatattcagacaaataaccagacacatagagtaaaagagttaacccatagtctgtatgacctaatgaaaagagcttagacaagaaccaaggagcaacagtctcaaatgtcagatgcctttgccatattactcccatttctttttttatagttaaaaatgttaaattttaaaggttaatgtgatgctgctaagccctctgtagggtgattgatcagcttaaatgtaaactattttggtgaccatgatatataaagtcatagtgttgaaaaaattcaacaatagttagaatcattttaagaaaacaacattgatatatgaaaatattcacaattgagaaatcttatattgatgaacttagagattatacattttggtcttgaggcagaactcatcttagtaaaactgcttaagaacttaatcttgatcttataaaataaataaagatggtattttgtattttaaactattgagtatgatttcttgctgggatctatcactatgaaaagtgattattggtttagagtggtgttctcgttattttgggttttgaaggagcacagttcatcctgttggtctgtgttaaccaggggtaggtaaagaggacagaggacacctagcaatggctcaggtattatcagtgagcagggtgagaaaatccttgtgtaccaagaggaattttgtcatggatttgcagaactttcaaaaacaagaaacattatttccacttttcgtgtgattcctctcactttttaacctcttttctcttttccttcttttcgagatggagtcttattatgttgtccaggctggagtatattggctattcacaggcatgatcattacacgctacagcctctgaactcctggctcaagtcatcttcccatctcagtcttgagtaactgggactatagatgtgtgctgtggtgcctggcagagcctcttctttaactgtaatagacctgcttatcatgcatgaaatgatctacaaacacaaagtaccctatcatcattatctctttggagtactatgtcctttaaatgtattttcttactgtaactaactacctaggctggaggtcctatctctaatttagaaatgaagaaagtgagacctacttggattgagtgagcattcgaagtacattcagaagtggaaattatttttaaaagttaaatggcttctagaggtcatgtagtctcttttgtcatatagtggagaaaacagagaagttcaagatttccccaaacgttcttagttactggcaaacaggagctaaatgtcattcttcctggattttagtcagtatttgcttggtcacttttcttagtagagctttttcttctccttgcattcataaacacttaataaaagtgaattgataatgatcatatatattatataattaggtaatattagccgggcatggtggttcatgactgtcataccagtttcatatattagaagaaaagtacaaattgtgtagctactcaagtgcaaaatgtagagagaaaacctagagaagacatgaaactctctccttgactaatatcttcaggctggggatactatgaacaatggtgtgttcagaaagaatgaacaaaattgctgtagtaactcaatttcagaagagtttgaccctgtcagaatcatctactgtatttgcatgagaaatatgaaaggagtccaagggaaagatgatgtgttcagtgttcttttccactgcattggagcacctgaggagctgaagagagaaacttgtgtttcttctttgagtggcaagtgtgttagttaatatcatcaggcagaacatgctttccaagagtttagtttgctccttcacaaactaaaatactctgaagtgcctgattttatgcaaattacttttggttgttgtattgagaaatgaaaggatgccaacatttttttttataaaccaaatactaattagcattaccaaatttatctgttgagatacaccacttatttgtaagagaagctctttgacaaaatgaaagaatatgaataaattcttcacactggctatatgagaccttggaatgtcattttcttttttttctgtagaatttgtgtaataccctccactttgttggactgaatgagatgcatacaaaacaaccttgtaaattacagcattctaggtcagaggctagaaatattttctgtaaaaggcaagagagaaatattttatgcttttgtgaaccataggtctctgttgcatctactcaactctgccattgtagtgtgaaagcatccatagatagtacataaacaaatgagggctgctctgttccaataaaactttatttatagatacagaaatttgaatttcatgtaatcttcacctattgtgaaatgttatttttctcttgatttttgtaaccatttcaaaatataaaaaatgactcttagcccacaggctgtataaaaacatgtagatttggtccaaggtctgcaattcactagcctttctccaggtgactgcctcactatgaaacagttccaagtataaagggattaggatatgatgctgatgttgggattgcatttactgagctatctaggtgattgactccaggctctctctctgatactgagaacatgccttggcatatgttcccagctaacgtttgagaaaactcattttcggaggaataattttctgttgtttgttgctgggagttgggcagaatatctcaggtagtggaaggaggatactgcaccacacaactcatagaactgaattgatacagatagatgtcagcatttctgtgcaaaaacaaatgtttcaaagttttgaggtctcagcacttttccaggcacagcattctggatcttggcacacagatgactctcagtttgaatagaaaatgctcacctttctttttgctagttttattccagagccaatctctttataataaagaaagcaactgaaaatggaaaactcactgagcttaaagcagccaaaggaaaaatatgtgctcattttaagttttttcttttgcaactcttggccaaataggtttatttttaaatacttttcacaatttacaaatgtttgccttaggactttgtgtaatggcattggttttatacagctattacagttagggtgaagagattttcttcacagagatggttttggaaaatgtctcatcacacaagtggtaagtgtagtcgctgtaattgtattgaagaaaagaaatgactaatgggaatcacaaaattgtgaaattgatgatcatttctgtttttattgcctttattttaaacataatagtgacaaagtctgaaacaatatttggagattgctacatatttaaatatttaatgcaacaagcatcccactttattataggagatagaacatcgactgtgcctaacctaaattacttttccagggggttttagtggattattttcctattaaaaaaaggggaaaaaagaaaagaacagtctggtacaaagtataggtgacggcttcagctttgtaattacctattaattgatatctgtatataagtataacaaataaagttttaaatactgaaaatgagatgagagatactaaaggaaacaatttcctgagaagtattaggttagactgtacaaatgtaaaaaacatgtcaacaacctggcagcaagtagtcttgagaccttgaagttcaatgagagcagatgaattgtctgctcttttaatagtaataaaaactatctaaggcaaaattttggcatgtaacttaagaaacttaaaaagtttctcatgctttaagacactttgattttattagatctagaatgaggtctgggaatgtatatttttataaagctccactggtgacctgggtcaagttttgcaatacagaatttgaggcagataatattatgtaggaggtaggagatttattggggagtgctagaagtaccaataccagtgggggagtgaaaaaagcatgtctgtagagcagaagaagctggactgcagagcagttgcagtagaatcccatctgatcctaaggagccctggagctggcattccaggccctggagagttgtcctggaatgaggcaaggaggagggtttgtacccttgcattcatcagtcatgggatacaggatgccccagggagtgggtgaaaacttgagggagatagctctttccaacagagggtagtgtccagagaaggtctggttatgaggtgtcagaagccaacacttgcaatcattggacgaatttcagtcctgaagttgtttctaggcagcacaccagtgtgtccattacaacaggctattcttatgattgaaaaacgattgtctaaggggttgttgggaagaagtacttggactggagggtaggcaaggagtatttatctgtttcttaaacatgtacggagtgcctactatgtataggtactagagacataaacatgaagagataagttccctacatttaaggagcttaccatctagtgggactcagatatgtaaataaataattaaaacataattgtcaaaacaggagggtatgtggtatgtgcatgtttccaggttttaaaaaagctttacttcacaaacaaaaatgttctgttcattctgcttattttgatttgatagattacagctcgcagagctaatattctcttaatgtaagtttcttccccttcacagatgtttttccatctcctctaatttctcatcgttctgtgatgagacaaccagagtctttaaaaaataaatactttgcttttctatgattaaatggtttgatgaaaattaagccataagcataaagtgctaaatagaataaacccctggcacataaaatgggtaggtcctgatatcctctttcaattcttcaaatgtataggtagatactgataccctgtctcaactgtagtcaattacactatatattttcctctataaaatgtatcactggccacgttcagtagccctccattactgaatggggcaattattcaagaatgccccagtgaatgcctgaaactgcacctggtaccaagtcctacatatattgtcttttttttatatgtacatacctatgataaagtttaatttataaattaggcacagtaggagattaacagcaataacaaatacaatagtaaaacaattgtaacagtataccaacatcactgctcttgtacttcgaggccatcatgaaggaaaataaaggtgatttgtacaagagcactaggatattgtgataacgcagacatctcctagacaggatctactggacaaagggatgattcacgtcccgggtaggagggggcaggacagagcgggacagtgggagacttcatcttgccacatagaatagtggataatttaaaaattaggaattgtttacttctgaaattttccacataatagtttcaaaccaagggtaactgaaaccatgagaagtgaaactgcagatatgggaagactcctatagaaaatatttgggctgggcatggtggctcatgcctgtaatcccagcactttgggaggctgaggtgggtggatcatctgaggtcaggagtttgagaccagcctggccaacatggtgaaaccccgtctctactaaaaatacaaaaattggctgggtgtggtggtgcaaacctgtagtcccagctatttgggaagctgaggcaggataatcgcttgaaccccggaggcagaggttgcagtgagctgagatctcgcaagtaattggttatttactacataaaaatgttacgtagtattcatatttatgtttgattgcatcacttttttttaaacttttggctcaaatattggtagttttcaaggaacttttctgcagcattatatgaatatgatgacaagtagaaaaaccaaaagggtgcatcaatgtatgaaagctggtgtgttaaattgttatcatcattaacaattcactgctgcatgctaaattcatagctcacacaattcaatttatgccttataaaattacaaactattacaagtcatggactttaaggttgctcaccaagttatcaagaaggtcaaaggtaaatgcaactgtactattctatggtaatttttcacaaatcccattgattcttgtttatgatactatttcataaaactcagggtcatataataatgttctgtttcaaaacatgttggtgtatttcaaggtctcagaaaaggtattgaaattttttggtgagccaaagagaacaggaaagatgatgttttgtctgtaaattccatgttgactctgagttagaagagactctaagggtcatctggttctgggctgttagttttgaggtaataacgttttcatttacaaaaagaacattggtaaagtaataaaagcttatttttgtatatatacttatttacgcacagattatacatgggaaaaatggtgcccaggcagtttgctttcagtgatatatgttaggtgaaggtcaggaataatattgacataagtaaatattggaatagaaggcaagacttggaggtgggatttaaacaaataaacaaagttttttttttttttcctttttatgctactttgcaggaaggtcatgtcaaaattaaaatagattctgctttctaccttggcaagtaacatgtattatgcccactcacatgtaggtcttatctgctttggcaaatacttacagaagaaagtgtaatttggaaagagaagaacataatgatattagacaaaatagggtcacaaaaatttacaattggaaaatgatttgtaagttaataaaattacctagagccagattctactgtctaaatataccactgaatgtaaacaagcttttgctgagctagtatagacaggtttgaaaaacttggttttctccagtactcactcttatcaaggaggaaaaaggcccagaaaaaaaattctgaagagtatttttgtatcatttacttatgccccatctttttctcaaatatatttaagacagtttatcagaatacatactatgtaagaaaataacataaataaggaaatcagggcaaacagaatgtaaggttttgaaaatgaaaaaggatctggggaatctgaggataaagttaacacaaaaaatgcttgaggatctgttcatctgctgaatgacggttacaaatctgtaaatattctgatagccaactctaagagaaaaacacagttatttcaatgtttatagttatcctggaggagcccaattctttctctaagtgggaccagagaaaaatttcccctttgtcctaagaaagaattcctacggagtatagggtaatcaagaactcatgaagctgtgtgtcctgtaatgccccttaagtagttagatgattgcaggccaagagcaatacagtcaaactgattttaccaggaagaaaaagcagtcagtccaaaaacaacattcttgtggtttgattaatccaaaattggttagattcaggaatggaaatctgcatagactttaggcaaacctcaataattatttctgtaaccaagattctgataattgttgaggaagtagtgaattcaagcttatgctctctgtacttcctgacaaatccttggagtgcatcactgctatgttgttagtgcgtgtggacccatatgcctttgatatttgccaggctggggatataaatgacatataaagatgttctaatgagggctactcactctcttttctctctcacagacacattcactcatgcccatgtatatacagataatcatatagacatatatacacacacataactattgaataatttgttgtttaaaaaatatgtttcaaattaatggggaaagatagattggggaacagatgggcgtcagacaatttgctatcaatttggctagaaatcaagttagattcctatcttacaagatatgcaaaacatagaaggattataaagtcaaattaaaaaacaaagtattagaagaatatatggagcatttttatactcttgcagtagggaaagatgctcagagcaaacatgaaatccagatcccataaaataaaaatacgaagtacttaggcaaaaaccaagaagaaataacaaactttggtaagacacaaatgatagtaaatgtataaaagtcaatataagtaaaattaaaagagaagtgataaacttggaacatgtattctaaacatacaacatgaagaagcttagtatctatgatttttaaagaatgtcaagatattaatatacaggaaaaacagcagaatagaaaaatgagtaaagaacatagtttttttctttttgaattaattgaatttgaaacagcggtttttctccttcgaggagtaggacttttcacaaagcttcagtggattgttctaaatactggaaatgatatggagaagcacgtctcatctttctggaaagcgatttggcaatgtatatcaaaccttaacattacaaatgagcagacccaacaaatgttcatataaaactcacacctaaaaatataccagacatgaaggcaaagctatatatacaaagggtgtttacagaaatattattcttatgtcaagtgtggaaaatactaaccgaagtccacatgtccaactgaagaggaattagggtttaatgatttaagaagatatcatgaaactattaaaattatgtttaatgttaattatataggaaaatccttgaggtaaagttttaaaagtaggatacaaaattatgtcatacacacacacacacacacacacacacacattttacaaaaaccaaaatatatgtatgatatgtattgttttacacatggagagatataagtatacacattataaatacaaattaatacttttggtcatacaggatgtctctgttttttgaaatacatttttcaatagttttgacatttttagccataagtatatatcaatagtgttatttgaaaaatatttaaacagaacataactcagttaatatatatgtactaaataaatttataatttttaagggcagaaaagcataaatatttcaggaaattctgaactaaaacacagttgaaaacttctaagactctatatcaatatgcaattgcaatgttaaataaaataaagatgttagcaaatagcacaatagtagttggcatattggaactagaatttcatcacgttatttgcaagacatctaatatgagtcatttgacccaatattttccttgtcttactctgggatgatgatacctctgtcatggggttgctgtgaagagtcagtaagatgtaatcaaccagcgaatgttaggtgctcagtacattttaattcttcatcctctttctctttttcctctcagcacagataccagatgtaaaaatgttatttatttttttcctagcactagtaaggagttgaaagtttttttccataaaaacagtgcccagttcttggtgatgacagcagggagacctttctcactcctcttcagggtgaaggtcagtgggttcgttccagttcattgactggttgttcacagctgacgttatcacgattagacaatgctttgccttaccaattatttaacgtaactgtgcttctgtctttgctcataaaaactctggtttggatacttcactcattgaaagcagcagaggcaaatcatcaggtatatatacagcttcaatgcctaagatattgggctacttttgctagttagcctgtggtccagtagccgcccccacaccccaccatctatttttggaacgtatacaaatggagaaagatacattaggttcctccattttaatctagttatttttttaaaaaaattataagtatgaattttaggctgtaagtgtaattttgttagatggatagattgtgtagcattaaagtcaggacttttagggtagttaccatccaaataacatatattggccagagacagtgtctcctgcctagaatcccagcactttgggaagttgaggcaggtagattacttgaggtcaggagttcaaaaccagcctggctggtcaacatggtgaaactccatctctactaaaaatacaaaaattagccgggcatggtgatgcgcccctgtaatctcagctactcaggaggctgaggcaggagaattgcttgaacccaggaggcagaggttgcagtgagccgtgattgcaccaggccactgcactcaagcctgggtgtaagagtgagactctgtctcaaaaaacaaaaaacaagtatattgtgcccattaaataatttctcattatttattcctctcctatgtccccacccttctgagtttctattgtctatctttttatactctgtgtccatgtgtatgcattatttagctcccacttgtaaatgagaacatgcagcatttatgtttctgtgactgacttgtttcaattaagacaatggcctccagtttcatccatgttgctgcaaaagacatgactttattctgtttttttttttttatggctgaatagcattccattgtgtacctattacatttttttttcccagtcatgcactgatggacacttaggttgattccatattctttgctgttgtgagtagtgctgtgttaagtatacaggtgcaggtatctttttgatataaagatttctcttcctttgggaaaacacccagtagtgagagtgcaggatcaaatggtagttctttaaactctctaagaatctttacaaaatcctgccactgtaggtataaaacaatatgtggtctcacttagaataaaatggagacattttaagaatgtgttgtttgaatcctggccatgttctttcccagaggctacagtttggtgtagttcactggatgtgcctgtggacactgaacttgactggctattggatttctgactcctggaagattttgaggagttgcagctcttgttctctttcatctcccacccatctccagaaaagtccaggttacacctgtggaagggttaccagccagaggacagagtgtgaaggcttgcctggtaatggcaaacccagttgccatccacatgtcatactttgcaccatgtccctgatttgtatgggttctgtacatgtcacagtttctaagagtgaacctctctgcccccccgcccacatgactctgctgtcagctttccaaacaatgagaggacagctcctttgaaagatgtaagttttccattccgaaagatataaatttcctggtcctgcagaggctagaaatacctcttgtttgggtcactggactcgggctaggtgatctgcaagatcttacacaatgctactctaatatttcctctgtctccagctgtttcatgactccatccctgccatgtgtgtgccttaccatctttttaagcagagcacaggcctgggcagtggctcatgcatgtaatcccaggctttgagaggattgcatgaggtcaggagttcaagactaacctgggcaacatagcaagaccccatgtctacaaaaaattaaaaaaaagccaggcatggtggcgcgtacctatagccctagctgcctggaaggctgaggcaggaagatcgcttgagcccaggagttcaaggctgtagtggaccatgatcatgccactgcactccagcctgggtgacagagtaagaccttttcttacaaaaataaagaaatagagtacagattgtaactggcaacagtgagtctgtctcctccctttcctcgggcatcagagtcaaaagaatgacaataacatttgctataattattttaagtttttttaaatgatatggcccacatatagaaaataattatcatgttgtcttctaaaggatttgattactagaattagataactgatttctttctttcaaaaagtggaagcttttttttgtttgtttgtttttggttaactgcattttaaattttaggaacaagtagattcttcttcagtcttaaacttcagcacctgctaaaaataaggattacgtattaaacattatattttcccccagttttctctggatgttactgcaaaaatttactcactctcatttggatcacaggggctgataaatgtgtgtgtttccagatgctgcaccaggactgaacctgtggagtaggaaatgattctaccttagatacacataccctcctctcctgtttttttattctaagtctccctagcctcttaggtttttgtttgtattaccctccctctttcctgcttccagccatccctattatgactctaagggtcccatgaaagattaggtcatctgtgatgctgtcagaggcctggagaagtcctccacctatgtgtgcgtcatggacacctggacacaggctaaaagcttcttgagcaacttggtaatggccttctgaaaaaaaatgcgctcagccaatgtattactaattctactgggggaatttccaagtcaatttctggggactgagagtggtacagaaggatgagggtgtttaggtacactttaaattcacagtgtatgatgtgccctgaccacccccatcctccacacacccactacttactcctaaaacaattttttctaagccaaaagtggtttatgacaaattgtatgtttgcagatttggagtctaaagaggagtagatttatttaagggccatatttagtgttagtaaaagctacacttactatgctaattgcaacttaaattagagctttacctttatcaccaaaaaaaaccccactgtcttcccttgatgttaaattgtaggaatttaaagtaatttaaatttctattttttctacatttccgctttttgtatctgtacaatatgattatacatgtgaatggttaacaaaaactgtatactttagtctttaagtggaacctcagtgcaatattttgtaggcattaaaaatgataagcactttcatcagactattagttttcattttgttgactttgtttgtttagttctttgtggtataccctgtagttataatgaaatgatgtaaatctatatatttgccaacacatagatgtatttctttttaacttaactttttagcattatgcaggaactgctgctcactcgctaattatcccacagcctcgcaagatggcatctcctgttttctagcagatcaggatcaaaactttggaatcatttctctttctcttacacctcatatcccatccataagaaattctctgcatgtatctagaacttggcacttcttaccactttaactgctaccatccgtcatcttttgcctggattattaaaataacctcacatctgtccttttcttgccattttatcctttattcattagccagaatgagccttctaagactgtagtcaaaagtcatacagctcctttactcaaaccctccatgaacttctgacctcattcagtgtaaattcccaaggtccttaccatgaccttcaatgccctttatcatctggtctattaatgccacctgacctctttttctaccaccgccctcaggtcactctgcttcagacataggggcatcactgatgtttcagaagcactgcagaacccttgcactaactgcttccagtgctaagaatgagcttactttgtataagcatggcttaattccttactttctttggtttctgtccacatgccactttctcagtgaggccttcgctgacttccctgcatgagctagaatccactctgcacctggcagtctggacattcttaccttggcttatcctctattatcctagagatgtctgtcttcatccccaacacctagaacagtgacggacacatgatagctacctcatgattatatttgaatgaataaatctttaattatccataattgggtagtagacccaatcttgcacaggcagccaagaaacaaaaccaagaaaaaaaaacttagtttctatgtagacctgccactaactagacatacttccttttgcaggtgtttaacatctctgagtctcaaatgtctcaagtattaaaatacaatagattgaactagacaatttcaaaagttctgcttgctctaataaaatactttacacgaagtaaacacaattccactgatgtttgttcaatattttctatggcaaggccattcctcattatatataactcaagtagataagtagcagttgttatttgtcatatgtatgtatgtacgtacacacacatgcacacacaattcaccctctcccacaatatcactgtgttacacaatcctcagtcctattacctctgagacccattgtaaataaaatgtaaaatctttagagcatgttggacaaatacatggttttggttctgcctctttccagtcgcagacatcactgtgagattatagaactctttccatctaggccaagactgggtctaagaattcttctcagacttctaggaaagatatcaaacttattagagttgaaactagagatgtaacatagattttattccaggttttgggtatctgagagcctagaagtggtgtgagataaagaatttgatacaccttctccagtctttttgcttggttttccttcaattcatccttccaaactcattgtagataccacttctcctaggatttttccccaaatccaagactgtgttatgtggcccttgttatctgattacctagggccctggtctcaattacagaattattatgttgtaatttctttttaattttaacttgactgcatcatctacctgactgtgttctctagaggttcagaccaagaattgcgttttgaagactgagagctgggcctgacacttactagggacacaataaatgttgacttattgaacagataaatgaatgaatgaatgatgcccaggatagaatatttggtactgctgtcctgtctagcacatttctccaaggtaaaattatctcccacatatgacaaaaatctacctttctcttggttaaatcccttagtaagctgcctatcagagaatttgagggttaactcattcttttagaataatgtaaataacttggatgggagcaggctgtatgctttaggtcaattagaccaccttctcatgcctgagggaaattgtcccttaaggtctgttctatggcacctagtcccctaagatttgacaagaaagcgttccacagttcaatatatttggaaaacattgctcgctggcctttccccttgaaatctggccatggacattagcttattagagattctgagtcatctagtaaagaattctgtttaatttttttatagctagaatttttcatttcttttgaacttaaggataatattcaacattatatatattaacattctactggactaatgctttaggaaacagagttttacacacatagaggccatttaatagctttaaataacagtgtagcagccatatggcagtgagcagattggatttggaaaggggtaaaaccagtagggaggatgttgcagaaatctagatggaagaggatgaggcctataaccaaagtcctcatagcggccacggagaaatgaaaacgtttatgcaagaaactgatctcgttactgaaaagtcttttgcaagagtaactaaggtggttagagaacaggaggttggtactgtagtgctttccctcttctgcctttcaaaggtaagagcttgacttcgtttttaagccagcaggggttcttacatagctgagtgtctatcactacttaatgcatgtataatgccctgctgtactgatattcatgataaaaatcaaggtatttacagtcaattataatttcttattctcaaagcatacattgattttcttaaactaggcttttctgaactgggtatgataatacacattattatcataccattattaggcctctctttccaggtctttcagtgaaatctgtgtgtgtgtatgtatgcatttcctaaggctgttggtgcaaagaaacacaaactgggtggcttaaaaacaacagaaaccaaaatcaaggtgttggcagggccatgctccctgtggggttctggcagatccttccttgcctctccctgttttctggccatgtctgtcaatccttggtgtttgctggcttgtagctgcaatgcttcagtctccacctctgtcattcgatggtgtctccctgtatgtctctgtctctctctgtgtacacattttcatctttttgtaagtacaccagccaaattggattaagggtctaacctactccattatgaattcatcttaactaattacatctgccacaaatttatttccaaataaggtcacattctgaggcaccgggggttaggactttaacacacctcctttgggggcccaattcaaccaataactacatctgtgtgtgtgtggtgtgcacgtatgtgtatgtgtttgtaagtgcacacgtaagatgcaccaacatagatgcaaagacgtttgtcttcccaaatttactagtagtatttctggctctactcccatgaaattacctttaccctttctctttgaaggatggacaaagccaggtctgataaagcgttagaatttgtcatggctggtcttcacgcggcaaaccaattatgtgaccacccaggccttttcatcatgcttggtacattcatggaatgttatctcacactggggttggtaatgcaatactaattctaaaaggctattctgattaatgtattcatcttggtttagcattttttatattgtttatttcagctctcctttcccttttgtgatctaaatatattttctttcaggttattttgctaagtggttccgagctaattttattacttttttgatggtaagggtctaggcagagtagcctttctgaaaggcaagctttaccgacttctccaggttcataaatattaataatgtgtaactacgactctgtgtgctaaaacattgttgtggagattgtacaaggaaggcattttatgatttcatggagacatggagtagcaagaaaatggagcaatgacatttggggggagcatgacatctaaatgttaatattgtgtactgcttactgagaatgagaatttctcttcttttgatgctcgtgttgtcagttgcacgagagtgttcttcaatttgtactttacttcttctagctattttttttctttataaaactgctagaaaagaagccagctagtattttgaataaaagagttgggattgtataaggcaatgtttttactcagctttcctcgaccttttgatgaaaattccagttcaaaataaaaagacacaggcactaccctctgagagagtctgtgtgaccaggctatcattcttaagaaacggattgaaacttcttagtacatctcataaaaaatttagttagctataaatgttttaggctgttgcagctgatatcatttgccttgtgggaaaaaaaaatgaggctgttttatgttaagtgttttgttttctcttctctctattctttttttatatgtattaggcaatgcaaagacttttactaccattgttatgatagtatttaaataagcagaccaaacccatgcatgggactgaagagtaaagtcaagaaatatttgagatgcctcttttaaattaaaggtatattcttcattgctaattttgagttcaattttttactgtatattaaaatgttaatttcaatttcatctatagcagatggtatcctgcttttattttctaaagggattcttcaagtaagccctcagttgtcttgcattatgagtaattagagaaataccttggttggtcctcagggcagagctaaaaatagagttcagtgatttttttctgtaattcttactatttttaaatagaagaaaatgataggcaagaaagaaaaggccatacttaaccaaaatgtccatgacttctttcattactaacaaaaaattgccaagcttgacagtttgcaaataactctcccttctccatgaaggtaacttggaattcgatgtgtgtgtatgtacctgtgtgagtgcatgtgtgtgtgtgtgagagagagagagagagagagggaccacaaagtctctgatgttaacaaatacaagaggaagagcagtagatgagggcagaggtgtggtaagcaattgatctggcaaaatcttgaaagttaagacaagaactctgggtgttactctgagatgggaagtgtttcgactcagcaatcccataatgggtatatattcaaaagaaaacaaatcgttttaccaaaaagatacatgcacttgcatgttcatcacagcactattcacagtagcaaagacatggaaatcagcctagggcccaccaacagtagactggataaagaaaatgtggtacatatgcaccatggaatactacatagccatacaaagaatgaaataatgccctttgcagcaacatggatgtagctggaggccattattctaagcaaattaacacaagaacagaaaaccaaatatcgcatgttctcacttacaagtgggagccaaacactggctattcatggacatatagatggcaacaagagactctggggacccttaggggcaggagggaacagggggagggttgaaaacctacctatgaagtatatgttcagtaccttggtgccaggatcatttgtaccccaaagctcagtatagtgcaatatacccaggtaccaaatctgcacatgtaccccctgaatctaaaataaaagttgaaagtaaataaatagataaataaatgcattaacttttttcatgaaaactaacaacaaaaaacctgagaagacaggccgcaaaaaaagaaatatggaatacatttaacctacaaagaaacaatatccagaatacataaggaacatctaaaagtcaatcgtagtaaataacataaaagcaaactgaaaaatacttcaaacgacattattcagaaaatgtatcctaatggccgataaacattaaaaggtgctgaacattcttaatcatgaaaatgaaaaatagaccatactgagatgatcatttatcatccagtattaacaaaaatctagaaattatgacaataagttttgggtaggatgagaagcaatactgctttggggtatacaattgctttggaaataatttggcattagctgtaaagtttgaagatagacctatttacaggttagtagtaccaatcctatatatgctgtctagaaacttctgtacatgtttaccaggaagcacatataagaatattcctagaattactgaaatggcaaaaaactgaaaaaaactgcaactatccaccaaaagtaggatatatagataaatcaatagactgatagattggcagatagataggagtgctatacagctgttaaaaataactgtaatgcagtgttactcatcaatctggatgaatttcaaaaccaaaatgctaagaggaaagtgcaagaagcagaaaagaccatagaaattattccatttctgtaaggtcaaaacaagcaaaattcagcaacatagtgttttgaaatgcattcatatatggtagaactatagagaattttaggagaatgattaaaagagattcagaataatggtcacctgtggagggaaggagggggctatgattggagaaggtcatgctatctacaaatgtgttgttccatttctcagtctgatagtagaaagatatttgaacatattattgttcttcaaattgtatatacattttaatattttataaatatattctgcattaaaataaaaagaaaataggaatgatatggaaccagcaacgacagacaacttttttaagaattttttttttttttttttttttttttaacgaaagctattgtcttctatggaaaatgttgtttgacctattagcacttgattaggttcccctccttttcctgaaacactataacttttccctatcatgtcttgtactaaatttatgctagctgcaatgctagataacactcctccagacaggtcttagtagattaataataaatgtttatttcttgctcaagtaagaggaaaaatgagattacctataagtagcagctcattttcaaaaggtaattcaggtaccttgtatctttaaatctggtggctctgctattttcaacatgtggcttctaaggtctctgtgagaggagaaagaatgggggcttgcacatgtgggacattttcatgagcaaggcctgcattttcctccatatgctgttgacagaactcaatggcataggcccgctaactggtaatgagctggcaagtgttgcctagctgtgtgtgcaaaagaaaaagagacagatttttttttcaatagctagccattttatccatctactttccaaatatccacttaaatctttcttctttgcttaggacccatttaccaagggtgacagtccagtcccatcaccgttttgagctcaaataacaatatctccaggcagtatgcagtcttctccatccattgtaaatgtgccttcttgcggtcttgcaatctctgaattaaaaagacaagttgtctccctttcacatcttcccctctctccagagtgggagacacataacattcactggtacatggaaagaataatattctgcaggagggtggaaggggtcttttcctagcagttctccttggctcttatcactgtaggctagtgcatagccccatgcctattgtatgactgcactgtgtcagagttcaatgagttcaagtttgtactattccctgttcatgataagaactatataatagttaattgctgatagtattattatattacaacaagctcaagtaccaagtgtctttgactttggctgaaattatgtgcacactaagactagttaccatggtcatcataagctataaatggtaattttttctatatattgtttaatatgtgtgtgtgtgtgggtgtgtgtgtgtgggtgtgtgtgtgcacatgcacacatccaggaaaaattattacttgacacctactttttcttgtaaacaacaatttatagtaaatatggaaggaaatttaaagggtctgtggcttgaacatgttggaaagtcttgctttaaagctccagcagatcctttctgtactaaggcacaaaagctatgatttttcatctgcccagaataataaaattatttacaaaagcactgagaattattctttatatgatttccaaccttcaagcttctgtagaaacattgtagctttgtaaaatgtggtgccttaccttggaaaaaaaagctttgttttgaagccgaggaatagtaaagaaaactgctatgtccctagcattaaaatcttatatcctcacaatgtgaacatgcaaattaactagaagaaactacattttaaaaattgaaagatttttttctgagatgcctttgcattttggttatctcttattggtcaaccccaggtcagagttaacacacctggctctagagtaatacacatgtacaggtgttgttaaaggctgcatgatggtattctgagcctctgctctgagctctgtcctagatataaagaatgtgcagccagctgtttgtctacttgtcctgaccctgttcaaggattaatgaagagatcctctatctgtagtccaatgtctattgggtagggaccagaaatgattgaacgtctttgcttcatgatacgctgtgccagtatacatgaaaatgggaacctaaaagtactttcataagcactttgtggaacttatttcttcctttaaaatgtcctagacaccttattgtcacctcttggctccctctggtttctgtattttcactggtacattggatcaccatggcagagccctaccctgcacccaacccaatagcaggaaggtttaccttcagcttgttccctgtatgctcagtttccggtggatttattactgtttttggttgtccccagaggctggcttatcatgaagttaaggatcttgatgcctcagggcttttcacttacatagaaccttccaagcccatgggtcttgaatctttgctaaatcggtccttgctctgtatggtactgctttaactgaaacacacacaggaagctgtgtccttactttgcacagatgtattattcaacactgtgaatactgtagtaataatttttggtattttccttgtaaaacaaagagaaaagaaaacaaaatacagaattgtgctgcttttattcactgagtagtgtttcaaatcaagctagctttctggcagtgtgacatcatggcttagcaaagagtccttagaattttctaacttttaacaaaatggggaccttaaacaatctattctctgaaaaataatgttgaggtttcacagtaggaatgaaaagggtgggacgattatgatataactaactcaatttttaatgaataatgaattgcagagttaatgcttgtcagaattttccaggaattagggagaaaatgaggaagaaaattttacaagtagagttaagaggaagaggtagatgaatgcacgatcctgcttttattttatgactattaggatagagatgtttgaaacctgctgagtagctggtggaaggggaaggcttcaaggataaatagtagatggccatgcttgtcccccgacacagggaacggcctgcgcaaacacacttggtttgaggatatctgatgagttcaaagtgctttaactactaagcaggtggaatggcaggatataggagtcgtggcggccactgtaaaactcggtggttcagatgtgggtgacatgatttgcaaatataattacaaagtgatacgaactgttaaattggacaagtttagatttaggtgacagtaggacttagaagagacatctctatatttcctatgctaagctggaggtaataggagaacaaactactttatccacccctgaaaatgagactgttttactgatggaaacatcatcgtcttgaccatgagaaaaatccaagctagaatcctggccctgtggtttactagccaagattctttgaggggcattaatatttctttatgtatacattgagactctgtgatgatacctaccgcttatgcttgctgtgagcatgaatgagccaagatgtactgaagagccatgttaaatacctgtagatagttaataaatagtatctttattgttatcaagtaaatggaaagaattcaaaagaagggagaaagagagaggaatagtaaaatgtcatgagagctggaggttatttgaaaaatacatgttaatcaattgacgttatcaatcaagtaatcacgagattaccacagatacccagcttggggacaggaccacagaagaataatttgtgctgcctctcttgacgataactactttggttgaaattctgtatccctcttactttgacaaatcagaatcaagcgtggttgaatcttaaagactttttttttttctgaactaactcttactagttggcacaatagttaaatgtgtaggaggaaaagaggatgacggagaatgcatattttggtttggagagaacaaaaactgccctaggataatgtttgaatacatggccaccaacaagcccaagcttttgtggaaaaacactaaaatggctaaagcctctcagcataactgctttgctaatttaagtgtttgctttgagagtatgtgaacaaccgaattttcttagttaaatttattaaaaatgactgtacaggatggaattggccaatcagacaaaaacagttcaaaattagacgacgtttttcatcacttcacacttttgcagtgtttgctacaatcaagacactgtgcttagatgctgaacgtgatgcaaaggagttaaagatgtagtccttaccattgatttattggaagcaatagcatattacaaatactttatcttgctctacaggtaggcccgatacaagaagtgttggctatgagtaataatttggaggttcttcaaaaaactaaaaatagagctaccgtatgatccagcaatctcactgctgggtataacccaaaagaaaataaatcagtatatcaaagaggtatctacgctctcatgcgtgttgcagcactgttgacagtagctaagatttgggatcaacctaagtgtccatcagcagttgaatggataaagaaaatgtggtgcttatatacaattgagtactctttagccataacacagaaggaggtcttgttatttgcaacaacatggatggaactggaggccattattttaagtgaaataaaccaggcacagaaagacaaatgtcacatgttcttacttatttgtggaatcttaaaatcaaaacaattgaactaatggacctagagagtagaaggatggttaccagaggctgggaagggtagtgggggctggtggttggggaggtaggggtggttaataggtacaaaaaggtagttagaaagaatgcataagacctactatttgatagcacagcagggagactatagtcaataataatttaattgtacattttaaaataacctgaagagtgcagttggattctttgtaacccacaggataaatgcttgaggggatggataccccattctccatgatgtgattatttcacattgcatgcctgtatcaaagcatcccatgtaccccgtgaatatatacacctactgtgtatccacaaaaaaagtgttggaagagtgttgtgggatttcacacaaggcactgcctgggtttgtgtcactgctctgctctcctataccactcttgtcacataagcaagagacacacagtctcatatggagtgacaaattcggaaatggaaattcttttacagttaattaattcaattcagagtgtctcctcatcatcatccagcatttcctgagggtacctgttttgtgtaatgtggtaagcatagtctcttctcttatattcttccaattaattactttttctagagtttaggcccttctgccggagggagatgcctgtgtggtcacaagaatatttttctccctgcctccactttgttttggtgaccttggccatgttagttggctttattaggcttccacttcacaatctgtcaactcgattaacacaggcctccctggaatacctggctgttttgtttaagatgaatctaggaatatgacttgtttcaaatccacatgtcatcttgaaatgagcttgtctgggtctttagggttgaaatatatcccaggcttcttggctgctgatgtatatttactattttaacttcagttatctttttagtctgaaggctgaatgacttcttacagtgatcaacacaaagattatccagtagtctttggttgaatttattgtcttgacttcaatactatctatcagcaatactttgcaaggtcaacttttaaccatttttgttgttctttgccaaacattgcataaaataaaatataacctttcttctaccatattgtaatactgttgtaaaaaattaaatgatttcctactattccagtttattctctgtcaacattcttttcatactaaaaaggttggttttagcttatagatgaaatgtttttctccaaacttatttatgataataacaacaaatacttttatagtgcttagtatattccaggcactattataaacattctaaacaccttctgccattaactcattgagtcctcacaataatcttatgggtactgctaattgtgcccatttcacagatgagaagattgagggcaaagaagttaagtattttgcttatggtcacaagtgattgggccaatgtttgaaccaatcacttgtctgaaattttgcctttaactatttcacattttgcctcactgttagattttagttctttgttctgaatttggaatgcgtataaccatacaagcaaacacaaatttttattttttaacttgtaatattatggctgacctagagcagtgacatttttagtccaagacctagatacagacaacaggagatcatgtgtaaagaaaatagaataaaggtccttttttcttatgcagggccagcccaagataaaattttgtaataggttgaagtatatctttggcatcttttcacctttctctccctctctcaatttttggcactcctcctttcactttcatctattttttgctccactttgattagcagtagcctgtctaatccctgagagtaacccatacatcagacagaaactccaagtacagtgatacgggaatcaatgtaccctacctctgaccctcaaatttctcctctcagattctagcctgagaaaatatactgaaatgcaaaggtttttgcataaagatgttaatcacagcgactttcttttcagtaataaaaatttgaaaactgcctaaatgtacaacattggaagaatggttaagtaaattgtgcattatacaatacaatgcagcattatgcagccattaaaaactatgtttatgaaaacttctccatgacagaggatagtacataagtttaaatgctaagaaaattcaagttgaaagtagtataatatcaactctagaaaaatacatataaaacaaggaaagaaaaagctccaaatattaaatgtatacagattggatataaagtgattatttatagtttattccgttttctaatgtattagttttacaatctagaaaaaataaatgatcagtttttataaaaaccttcattcacaataaattgcaattttttcttaatcctcctagatatattgtcattttcaaaaatgatacttgccaatcccagtgtctttaattagtaggattctaagcagcacaagaaaatatagaaaaagattgaagaagtgtagagggaatatattcaaagtatgtagtatgtaagctgaaatagagcaaccgcaattgaattctcagatcactaaacttttcttgctttacacaaattttatctttcttaattcaattttttctttttcttttgtgctttctatttaaaagttaatgttttgttttgcattatattttttttcctctctgtgttggaagcaaagacagtaatgggaaaaggggacaagaaacggggcaaggatacactgaaggtgatatatatgatatatatatatatatatatcttcatagatggtggaattataaatggattacatatatcagatagaattaagtgtttgcaaattaaggcttgtttatactcttttgcaagcaatattttaaaatctgtttgtttattttttttatttttggaagccaagccagcagttgtttaaaattcatgcctctgcataatatatgaagactacatagatgagttttctggagatttctccttgacacatttagtttctccacgttgcttgtagaaaggatgattccattctctcaataccaccttccaccaggagaagccattttctttcctgaaggtcaacctacagccacagtagaagaggaaaccagttactgtgattccaaatataatttcccaggaggtgaaattccctctcctaaacatgaattggttacaggaaaagaaaaaagaatgtaattcgtaagactgtggagccattttcctaatccaatttctcctgtcccctagatcgatatcatgtgaattgcttccacaggggactgtgctagcagagaggggtctgtggaaagaaagaagcaccgtgctccaatggaccattattattgtttccatatcacagggtccacatatgcatgtaaatgtttttatagtacacatacacaaatgcaaaactgaatgtctaactaatgtcaagcacggtcacatacacccacactctctaatttcctgtccaaggtggtgatctgtaaaagagaggtgaactgtaagagctgaatgattagaaaataaattctaaaactcaagtgcacttaacagtggacgtaatcagtagagagaactaagacctttaggattctgatgcatctgtcacctgtaagtaaactgacagttctgtttttttaattattattaagcatgagttgctatataaatcacatctcattacaacaagccacaagtgactatctacatttttatgcaaaatgaatgctatcctactaaatgagcattgcctaatattgggagtcttttcttggtcatgcagtgatatttgctgataggggatttgacctgtcatagctttcttctagttttgtagacatttcttgttctctacctccctggttcccagcgtgcttatataatttgacaatatcttttggagcaatttgaaaatatgaatctcaggtcattggaatttgtgtattctaataaaaactggcataataattcagaagtggaattcattgaagaattatgggctcccaaatgctagtcaaattattttttatagaggtggaaagaaagggtcattctgtttttatttcaatccccaaagtatagattaaggcagcagtattctaggtcttacacaatcataggaggtgggtaacattgcaggagaggaggaaataatattcgttgactgtttactattggcaagacatcttaccaacagtttaatactctttgcaactctgagccagttggctctctctgtatatcacttttggaaaagctgaaatttgtaaattagtcccaaactctaggtcagagggtaggggagtgaaggaaggtttcattaaataaatggcccttgggctagtaattaaagatgactatgagttacctgagtaacaaggggagggaacagtgttcttagtagagggaacaacatttgcaaagaatcttcagtgggatggagcttaaaaataaggcaaacatggctgaaggacagagagtgtgggagagtactatataagctaagagggaggatataggcaggagctagatcaggcagtgctttgatggccattttaaggaattttaagcaatgggaagcttgaatcaaagactgtaacatgagcagatgtgctttttcaatacattattatagttgtggtgtggagaactgactgtgtggacacagacagactttcacttcaatcatctggatgaaacagtggtagcttagatggatgtttgtggtagagatggagagagatagagagtttggggacgatgggcagaattaatagaattcattgatatgaagatgtgaggaggtgaggaagagaaagatgtttaaggtgacatagaactctgcatcatataataaaatggatgggggtgccgtttatggagatacggaatgctcaaagacctgagttttatgaatttgatcatttttctaaataagtgcttgattaggagcatggatcacctatttggttttgaacatgtatttgccattcctgtgactcatgtaaaagaaatgtgaaaaggcagttggatctggactctagaagagaaatctagattcacaaactcgggaatgagcattgatgagaggtggagaactacaacagttattagccacatccaggagaatgagcctacaaggagaaacagaataatccaatagttaggaggaaatcaggaagatgactgttttgtggaaggcaaggtaattgatgtttcaaaacaattttgttggtttttgataatgtggaagttatgggcaagagaatgcttgggatgctcaaagaccagcaagaagaacagagtgactggagctaagtgggcaagatgattagatttaaaggttgattttaggtgtgatgagaatgcattaagaggttttgagtgaagaggggatatgacctgctttacattgtcactggactacagtgatagacagtgaaggaagcagggatggaagggcttggggggagaccaattaggagactgtgcattcaacattcagctagtatttatttaacatccagtatatgccagatatctgtaatctaggcttgtcatttggacttggacaaggaagaagtaatcaaatttgagatatattttgaagtcacagccgttgggatttgccaatggattgaaaatcgggatgtgaggaggagatgaatcaaggataatttcatggttttttggcttgggcaatagagagaattgcagtggggctgagactggtagccatagacaaggaacagaggtgaatagggagaggagcacgagttcagttctggatttgataaggaaatggtaatttttgtttataagattcttatgaggataaatgaagtaatgtctgtaaaggactttataaagagcataaacacttatcataagattattgttgttactattattagagtgggccatagtgaaaaccagtattctgatttgttgggccacctactgtgttttattcttggctttgtcactaacttgctgtgtcactttgagcaatttattggttctttctcaatctcaatctcttcctctctgaaagtttccaaagtgaacattagagatggaattgactagaagatcaggaagatcccaatcagctgtaacacccctatgatataaggctgattagtattatctcagtattattttttacattattgatattgatattttacttttatacagaagccaccttccaaagtagatttatcatattctaatgagcattgtgaatgatctcatttcagagataaaaatgttgaagggctttaattatatttaaagaaaaacagcaaaaatgaactcttatgatgaaaatcagtcatcaaaaaaaaaacctgagagatgagaaactacaacaattatccaccctcccaacatgtatgcagctattttgaaagaaaacatttggtacctgttgttagattttggaaggttacacacaaacttggaaaactgtctaaagaaaagccaagggatttttgagttttaattacttcttttaaaaagtaaacagtagtcaattaaggagccataacttgtcttctattattaaattaatggaatcatgcagtaaaatatcagtggagactgcggcattcacctggacagacactgctgttttaattatctatagagtcaaatctatccaaacaatcactctcataatgtaagagaaggaaagaaaaactaaaaactagtccatctctaatttttctcatatatcagggtttttttaagtttacttgctcttcttgcctccctgactcaatttcatccctagattattgcagcaatatcagcaactattagttattattttagttcataactatttgttattctttggatctaagttactagtatctagagtggttctgaatgaccaggtatgagcagtgtggaggattggaaagcacatattctgaagaggtgttgaactgaaacacatccttctaggtacttagctgttttgtttctaacaacttaaagatgttaaagtatgttgttcacatctgcctcaatataagtggcagaagcaacattcctggtatgaaaatatgcacccagagaacttaaaatttccttgatcaatgttaacctgctgttgcagccaatgacatatcttttacctagagctagaaggtactaaggatgaaatcttgtgggattcccatgtaatatagtctgaatgtgtgtctctgcccaaatctcatgttgaattctaattcccaatgttggaggtggggccttgtggcaggtaactaaattatagggatgagtttctcatgaagagtttagtactatccccttggtactgtcctcatgatagcgagtgagttctcctgagatctagtctttaaaagcgtgtgatgcttcgcccctctctctcactcttgctttggccgtgtgacgtggctacaccctctttgccttccaccatgattgtaagtttcctgaggcctccccagaagctgagcagatgccagcatcatgcttcctctacagcctgcagaaccatgagtcaattaaatccccttccttcaaaaattaaccattctcgggtatttctttatagcaacgcaacaatgaatgaatacaccatgggatgctgctgatgtttggatatcctctcacttctaatccctggaaagaaaaccttgcattccagagcattccatctaagcagctggaaccactccttaggtaggatctcagtggcccctgtaacaagtactatgattatagtggacaagtacaactgctcctatctattcaaatggaagaatgaagggacaatgttatagttacaaaaagtgcaaaattttattgcaaaacttcctagtaatgattctaattatctttattgaatgtctgccattttctaggcactggagtgggggttgatttggtttcccttatctacctattcaggtagataagggaaatttacgtggaagctgaagttccttactagagagagcattatcacctctaactctgaacccagtgggcactgctagttttgtagttcctggagttgcactctgcctttttttcctcacacttataactacttctccagctcctgccctggacaggcctgcactgctctgggcattctgcccactaatgactagtttttggctcatttcctccagaggctgcacagggaagagtgacctgtgtggccttatctgtaccatagattttctttcttgtgtccagctgtaatcccaatttatataaacatgtctatacctgagaccccagtcttgataccccaacatataacgtcttgctaatcaccctcacatagccctttaagaaggtattttataattaagagacttgaaactgagaggcttacttgcccaaggtgcttgggaatgcattcagatccacactgtgtttactgtactgtgctgtctccatcccattgtacattactcatttgtaattccagctgcttttgtttgagtgactagcaagtgttcaagtttcactcacatgccatactcttagaggaagtaaataacgtgtttcttgaacctcactgtgttcaggaagtactttatttaaccttgcctgcgggttaatgaatccttgctctgcttcctagggctttatgtatgattaaccaatatacctgactatatatttgaaaagttggccaaatactatatctggggcatggggttccactgcactgcagcagcgcgtatttacttgctcccagggctgtccactgttatgagagagagagaattcctactctgcattctaccccatcaccaactgcaatgtgagaagcgaatcacaattattttctcagtccctgaagtatttgctccagaaggctttatttgatgctagaaaaagattttcccataggatcaagcttgtttatggtggttaagaagaccaagaggggaagaaaatctgttagggcaatgtcagcttaagagagaagctgaaattatttattttagcaccttatttctacatacccctctgtttgattagctagacatctaaatccatgcaaagcattgtttatataacacaatctgcaagatccttacagtcatagcatcttcatcctccctcccctatgtaggcttacacaattgagaggagacaactgaagtctcaattcacgtctcacatttcacacaaagaacatcagctttttgtatcatttactctttacaaacatactattgattgccataaaaaattatctctgataacacactcataacatcctatctgttatttacccatctctgtgaaactgattatgagatttttcccaggtgactagcaggaagcaggtctgttaagggcaaaggaggaaggggtacagcttgttttgtgctgaaagaagaccagagaagtcagtgaagtcaacctcctggacacagctttttcccaagctgaccctgttgactgaggaatgccgagttacattaatgatggacactgtctgcccatcatggaaagcggagagctacatgtgtgggaaagggtagtaaactcctcctccacaactgtgcctccttccaagcttagatgacagaatattagtgtctgttatccttacgacatctctccatctggtcctctcaggatttactttatggtctgttttatttcccttttactactattagaaacaaacagctgaaaggattaatcaaaaatgttactgcttcaaagagtaaaaaacatgttacctgtttgactggtgcccatatatagttaagagtttctgaaggaagaagggtcacgcttaatagatttgatgagtccattaagcctggcttccatcttgttgctttgtttgtgcatttatttccattttggtatcttagcagtcatcttcttttagcaaacattgaggtttcagtctattgggtcagggtattagcaatacattaaccaaaccgttgaagacaaggggccagacatattcaaagtgtgatccgcattcaatatcaccattctcttgcaattgcaaagttataggcatcctttggatttttgcagcacttattttataagaaaaggagtaaataaagccacatctctgggatatgctttgagatgtttaagattgggaacattttcaggctgtctcaatactggaaatttgttgtccttttttttcacacattttctccctcttatactactctttaccaaaaggtgggtaaagataaggagatgaaaaaaatgttgcttaagtttttggttgccagctctgttttaagcctgacatagaagggggttgaaatttattttcatcattcagttaagagctattcttggctttcacaaatctcagtcctaattctgttattgtttcagataatgtagaatttgtcacattggctaaaaaaacaactccactaaatcaggacattagttttacatttcactgtgctacattctaaaataaaatgaccatttgtgctggggatgattttagaaaagcgaataagtaatataaagttttcctggttttctcatgggcagcctagaaaaatgccacaccaagactcaagaaattacattctgaattttgcatgaagataagacttgaagaaatcttatttcaacttatactttcctcagtttatgtcctgtaggaggaccctgtagagggggaatgcagaagaccagagggaagaaaatagatggtgtcaattgttatcaacacacgatagtatcacatttttattgagatataatttatatataataaaatatgagagttaaagtattaagttcaataaattttgacaggtgtatatacttgtgaacaaaacttcattaagatacagatgaattctgtcattctagaaatttctttatgcaccttcccatcctttcagaaaattcctcatgcccctcactcctccttctcctctatcactcatagaggcaaccactgatttctgtcactatagtttagtgttagctgttctcgaacttcatataaatggaaacatacagtgggtactctgttgtgcctggatttatttatttatttatttattacacctttaagttgtgggatacatgtgcagaacgtgcaggtttgttacataggtatacacgtgccatggtggtttgctacacccatcaacctgtcaactacattaggtgtttctcctaatgttatccttcccctagactcccaccccacaaaaggccccggtgtgtgatgttccccgctctgtgtccatgtgttctcattgttcaactcccacttatgagtgagaatgtgcagtgtttggttttctgttcctgtgttagtttgctgagaatgatgcaatcccattactgggtatatacccaaaggattataaatcattctcctataaagacacatgcacatgtatgtctactgcagcactcttcacgatagcaaagacttggaaccaactcaaatgcccatcaatgatacactgaataaagaaactgtggcacatacacaccatggaatactgtgcagccataaaaaaggatgagttcatgtccttttcaaggacatggatgaagtgcctggattatttagcttggtgtaatggttttgagatttatctgggttgttacatgtactagtagtttatatcttccattgtgtgagtatgccacacaatggatatttgggttgtttccagtttgggaatattatgaaggtgccatgaacattcatgtacaattttttatgccaattggctttaatgtctcttgagtgagtacttagaaatgggacggctagagcataagctaggtgcatatttagatttatgagaagtggttagttttccaaattggttataccattcttcactacctgttacccactgaatgacatactctgtgttctagccaatgctttaatgtcatttacctttttaatatgttaaagggtgtgtagtagtaactcactgtggttttaaatggcatttctctgatgaataatgatgttggataacttttcttctgcttattggctacttacacatcttcctttgtaaaatatctatgtcttttcactcattttaaaagtgaatttgtcttcttatagatttcatacatgttccttacgtattgtggatatgattctaatatgggaattgtgaatattctctcccagaatgtagcttgccttttcaatttcttaaaggatgtcttttgaagagaataattttaaaatattgataaaccctattttatcagtgttttctgttatcattagttttagcatactgtctaagaactatttgcctatcaagtttatgatataatctctttttttttcttctaggatcttcagacttttagcttatacatttatggcttatataatccatctcaagtaaatcttcatgtatagtataaggtcaagattaatttccttttcatatacatatccacttattctagtacattcatcaaaaagatgtttctctccacatttaattgcactggtgccttttacaaaagccataagtcacttatataagtgtgagtttattgatggactccatattttgttgtctatttgtctactgtatgccagtaccatactcttagttaaattttaaagttagttagcatacgttctctaactttgtttttctcttttaagatgttttagcaatttgaaatcctttaaaactacatatgaattttaacatcagcttatcaatttcttaaaaagctggctcagagtttgattggtattgctttgagtctataggttaatttagggagaattaatatgtttacaacatttagttttgcaacccgtgagtctattatctctctcaatttatttagatcatcactaatttatctcaccaatgttttgtagtttcagtgaagatagcctaagtcttttattaaatgtattcacaagcgttttctagtctttgatattgtaaattgtatagaattttaaatttaactttcaacttgtttttaatggttagtagcagttacttcctcctctgatatcctgaacccctcaaagttacccatgcggattggaatcaactttgtccaaactcttgtaaatgttaatattttgatttaaagtgaaagttgtcctgaatggtaacgcctaggttttcttctagggtttttatggttttaggtctaaggtttaagtctttaatccatcttgaattaatttttgtataaggtgtaaggaagggatccagtttcagctttctacatatggctagccagttttcccagcaccatttgttaaatagggaatcctttccccattgcttgtttttctcaggtttgtcgaagatcagatagttgtagatatgctaccattcaggacataggcatgggcaaggacttcatgtctaaaacatcaaaagcaatggcaacaaaagccaaaattgacaaatgggatctaattaaactaaagagcttctgcacagcaaaagaaactatcatcagaatgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacaggcacttctcaaaagaagacatttatgcagccaaaagacgcatgaaaaaatgctcatcatcactggccatcagagaaatgcaaatcaaaaccacaatgagataccatctcacaccagttagaatggcaatcattaaaaagtcaggaaagaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactgtaaatcatgctgctataaagacacatgcacacgtatgtttattgcggcactattcacaatagcaaagacttggaaccaacccaaatgtccaacagtgatagaccggattaagaaaatgtggcagatatacaccatggaatactatgcagccataaaaaatgatgagttcatgtcctttgtagggacatggatgaaattggaaatcattattctcagtaaactatcccaaggacaaaaaaccaaacacctcttgttctcactcatagatgggaattgaacaatgagaacacatggacacaggaaggggaacatcacactctggggactgttgtggggtgaggggagtggggagggatagcattaggagatatacctaatgctaaatgacgagttaatgggtgcagcacaccaacatggcacatgtatacatacgtaactaacctgcacattgtgcacatgtaccctaaaacttaaagtataataataaaaaataaataaataaaaataaaaataaagtgaaagttgtgtgactcttcctttcacttgaaaacttagaggttcctggagggttattaattgttttaatttcactattgttttgtctcagggaatagggaggccagaggagagggagtgagataaggaacagacagtttgtggagcagttagaacacacataacatttgttaagttgaccatcttgcgtgggagtgatttgtggtgccccaaagccattatggtagtaacatgaaagatcattgatcgcagattaccataacaaatataatgataaaaataatgtttgaaatattgttagaattgccaaaatgtgacacggagagatgaaggaagcacatgctgttggaaaaatgatgctgatagacttgctgaatgcagggttgccacaaagatttaataggtaaaaaatacagtatctttcaagtacaataaaatgaggtagcttctatgtccttgtatgtttcatgggactttctatgtgcaccattatgtcttctgtgaataaaggcagtttaacgtctttgacaatttttttgtatagcattgaaaaagtttattttgagttaaaaatgtgtccttgtaaatttcttttctttttttaaaaatttcttctaaaaaaacagggtacatgtgcagaacatgcaagttggttacataggtatacatgtgacatggtggtttgctgcacctattgaccagtcctctaagttcccttccctcaacaggccctgatgtgtgtcattcccctctctgtgtccatgtattctcattgttcaactcccacttacgtgtgagaacatgtggtgtctggttttctgttcctgttttagtttgctgaggatgatagcttccagcttcatccatgtacctgcagaagacattatctcattcctttttatggctgcaaagtattccatggtgtatgtgtgtcacatttcctttatccagtctgtcactgatgggcatatggactggttccatgtctttgctattgtaaatagtgctgcaataaacatatgtgtgcatgtgtctttatagtagaatgatttatatgcctatgtatatatacccagtaatgggattgctgagtcaaatggtatttctggttctagatcctagttatgccttaaacttttattttctgtctaattgctctagctagggcctctagttacaatgctggatagcagtgatgaggtcagataatatagtaattattaaaacttcccatataaagaattcttgatccagatagcttcattaattctctaaatatttaagaaaaaaagatactaatcttatgcaatttatttaagaaaataatggagaaaagaacacttcccagcttgttttatgaggctagcattacttgacatgaaaacctgacaaggacattattagaaaagaaatcatggaccaataatgttatgagcatagacataaaaattcgtaataaaacattagaaaattaaacccagtgatatgcataaagacaaatttaccagggaatgcaaggttagtttcatatttgaaaatcagtagtgcaagtcatcatatttaacagaataaaggagaaaaatcatataatcatctcaatagatgctgaaaagcgtttgaaaaaaaggtaactcctgttcatgattaaatctctcagcaaacttggaatagaagagatatttctcatttgataaaggaaatctataataaacctacagcaaacaacacatataatgatgaaacattaaaacatttctctgtggaatttgatcttacttgcttatactttcattaaatgcatatatgacattttgtaaaatctcagttgctattattgtattattatgacctacatttagttagatgaaaaacacttttctggtacccaacaatttgtcattgccgtttagataccatttaacagtttttctgttgcatctacaagctgggtccacaccagattgggagcacactccaaagcaggacttctctgtttagcttccccctttccatgtttaaaaactttcaactgtcagaaaaatacagggaaaaatgttgtatcatgaaaccaagtaatggttcttctattaactcaaatactaaagtatgactatttgattagggatgctagatgtgagaatggaaataaagggatacaagaggcatttaaaaatagatagttggccggacacagtggctcacgcctgtgatcccagcaccttgggaggccgaggcgggcagatcacgaggtcaggagatcgagaccatcctggctaacacggtgaaaccccgtctctactaaaaatacaaaaaattagcctggcatggtggcgggtggctgtagtcccagctacttgggaggctgaggcaggagaatggcgtgaacctgggaggcagagcttgcagtgagccaagatcgcgccaccacactccagcctgggtgacagagcaagagcttgcagtgagccaagatcgcgccaccacactccagcctgggtgacagagcaagactccatctcaaaaaaaaaaaaaaaaaagatagttctggaattctgagtgtacacagaagataaaggatggagataggatgaataaagaataggagattttgtacatgttattttcttttctgagattagtcttgcctcttgtctttgactagtcaattcctcctcatcttgtttttaatcaacttttttgagataatggtagattgacatgcagttgcaagaaataatacagagagatactctgtatcttttactcagtttgccccaacggtgatatcttgcaaaactataatacaatatcacaatcagaatattgacattgatacagtcatgataaatagcattttcatcactacaagaatccttcattttgtgcttttacagccatgatgacttccctcctgaccccattccctgcttagcccctggcaactactattcctataattatgtgatttcaagattgttatataaatgaaatgatgtagtataatatgtattgaaggtagatagagtgattcctcccacttcataattaattttttcaaatatatttagcaattctaatttttctcctcatatgaattttagaataatctatatatacaaaatattttgctgagatattttataggaattttgttaaacttgtaatgtcaattatgggagaatttacatgttttttatgtagtatcttcgaatccatgaacacaatatgtatcctcatttacttacatcttctttgatttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaasggtccccagagtgtgatattccccttcctgtgtccatgtgatctcattgttcaattcccacctatgagtgagaatatgcggtgtttgatcttctttgatttatttcatcagtgttttatagttttcagtatacaagttagaactattgttatatttattatacctaaatatttttattttttgagtgattataagtgttactgttttcaattttggtgttcacatatatattgctagtatatagaaacacaatttattttgtatgtttatcttgtatcttgcaaccttactgaactcacttattagttctatgcactttttttatagattctttgggcttttctaaacagaaaaacctgtcatctggaagtagggactgttttctttctttctttgcagtcagtctaccatttatttcgttttcttgtcttcttggactggctagaacttccagtactatattgaataaargcagtgagagcagaaatgcttgccttgtttctgagaatagtgaggaagcattcagtcttttatcatcatgtgtaatgttagctgtasgttttttgtagatactcttcatcaaactgaagttctcctctatgcctgtgtttctgagagtttttatcaggggtaagtattgaattttggcaaatactttttctatatcctgtgtagttttccaaacttggaaactcttctgcactctagctgccttcacatgggcaagtgttttcatatcattctgtgttcctctgtatgctttgccagaaaggagttcaccttaaattttaagacaatgttgtggatagagaaaagaaaaactttctgtgtcatggaaaagaggtcagaatttgggccaagattttactcctggctcttttatcaggccaggattttactcctggctccttctatcctttgcatagtgagatcatattctctttgagtctgtttcttcatttacaaatagaagaaaaatagctgcagtgatgatcaggtgacttgatagaggaaatgcttagtcaatgtaattggtttatagatagtaattaatgtgagagttttccccagatttttatagwcttcctttatcatttattgctttaccacaataagtcatttgtcaaggaggaacacgtatatttccctagagaacacaccgatwtgagaacatacgaagcctacactcctcattcaggaacaggcaagagacaagtgtacatctagttccaccaagaaaacacacacacacattaacataccagtaatagtaagaaagcttttatggagattctgaaacatctattagaccttgaaagataacttagtatttacatgggaggagacacacttcaacctaccacgttaaaaaagatcccctgagttgtatcctgagctgtcgtagataagtgtcttcacccctctgttactagcctgtgttcagtctagtaaaaagcctgcaatgagaaaggaacaatgacttctttggaaagagaaaagtgtatatgttttggggtgggattaagagaaacagagaaaccaaatgttcctatgggaagctggaacttactcagcattcacttgagaggaaggacaacaagcccctgtgcaaacccctaggaaatgtcagtagagtcaatttctgaaaaatagataaacagcttggtaaagtaagctaaagaataatagtgatacatcccagattttccaggatatttctgattgaaattgtccaattcatttttggtgatgttttaatttttgatttgggaaacacgaacactatacttctatgtttagctttagtgatttttctgccacaagcaatactctagactttagttgagtttttccctcttaattaaataattcttatttgaatatatttatgtttattttaaaaaaggctactgagtacgagattaccacttgttacgatcttgctccttggagcagaacgtgacatctcatatgtatatatacttagctctcttgggcaaaagcttctccctttgttccacatggtcatctgaacattccgtgaagcatttctatcctcccaggatgttttatttcttgttttcatgggtgaagagagactgttttataaaagttttcaaatacttactggatttgtatcctaaagggagaaagcagcaggtcattttttttttctttcaagggcttgctgtaagttggtcttcctcttaacacgaagaaaagaatgacattcttcatgaccgccattgtgagtaggctgtattacattaaagccccattattagcaggctgtgccttggctgattttatagagagctcaggaacagaagtgtagaacaaaaacactgatatttttcactggcacaaactgcagatactttacttgttgattaatttgttaaaatgtgtggcagaacatttagttatcaggtagtcattctgagtaaactagagtcctatgctcctttaacaatggaaaaattatattttcctttttctaatatcccagtgttgtatgtatgctcatttatgttcttggtttaacaggaacattgaacattccctcactttgaatctactctaactcctgtgtttgtgtattttcaccacagtaagccataatatataaaatagtacaattaagaaaaccttagccagcacggtggctcttgcctataatcccagtactttgggaggctgaggcaggtggatcacttgaggtcaggagttccagaccagctttcccaacatgcggaaaccccgtctctactaaaaatacaaaaatgagctgggcgtggtggcagttacctgtaatcccagctactcaggaggctaaggctggagaattgattgaacctggaggcggaggttgcagtgagccgagattgtgccattgtgccattacactccagcctgggtgacaagagcaaaactctttctcaaaaaaaaaaaaaaaaaaacttaagtaatcttcataagtaaatgatatatacttaaatacaaattatcacatttataaaagaaattttctgtatttgtccaacatcggtcaaattccttaatcttataacaattgacacaagaacaagaactgccacccagtccacatttatcttctctatcatatttaagatattgcagggctggagtatcttcttaggatatactttcatcacaacagataacctattacatcagagattcaaagaagtagaatgggagagagaaggagttatattttttttaccctaaatgatgtcatcaagtcactatgctaatggagattgctgcacttgagattatgtgccttacaaaataatttaataatgactttagacagctgatatttcccatatagaaaataagaattcagcttatttatattctggaaagaaccatatctgctgcttagagtgaagcagacctgcagtttacacaacagttgagaataatcttgtttaccaagctctttggataaatagaaaaatatccaccttatcttgagttgctgtggtaatcagctgaattagtttactacttaagctctctggaagatgattggtgcatcatctgtgaagatgactggaatgttagcccactgaagttataacttgtggaacactgttcaaattaccgaaaagagtaaatcaactatctgctggtactcagttctcagggagcagtttacaccttgaaaaatcagatccaacacatactaaccatagtttctcatgttatgatttctggtggaattcctttagactcagccttattcttcaagatactgaatttttgggaaccctaagtacagtttctccttcttacatagagacttgatgttcctaactggtcgcaaacttgggttcatcagaagaatctgctccccttgtgagcacaaataatatctcagtgaagagaaagacactgtcatagaagagtcaacatttatggaatttcctggaatccacagttatcttaaactctgttccactttctctggacaccagctaccttcaatagtgccaggttcagtgtctaaccatggagtatctcatagttggactgggtgagtgcagatgcagttgcatgagattttgaaacatcacattataaaaaaaaattttcaggtatgcaaaaggcaggagagaacatgtactccttaccctgctttaaaaatttctcaacattttgccaattttgtgtcatctattccccccaatcataacattttttgctgaaatattgtaaagcaaatccaaaacattatttcattttacctataaatacttcaataatttacatgggtttttaatggcttgctatttattttcagggtttcttttagtatctttgacctctgtcacagctcatcttgcaaggttgcctatctcattgtcagagagctctagctaaagctcattcatcgttttgtgaactatgaggccacatattctgtgttgacccaagttgggccagaaagacagttttcaagagggcatggcttctaggtctctgccgcagcttgtccactttctttcattgtcagctactagaactatggcagcccatgctgggatataatttttcattgggcacagaaaaagagggtggcgttaggcagaatcaaaagtaggagctaagaaaatgaaaaagacaaggcagaaaatatgccaaaggtgcatatttaagggataaggggaggaatctgtgatgttgaggatgagtccccttgaagtaggggtgcacacaagagtctcccaacttgtgaattactaaggacaccaatggtgaactaatttataatagttgtctcctgtgactgagaaggctgagagtggggattatcagtaagaaaatagctcagaggcaaccaagttgtatggatctttagaaagggaagcaaggaaatagacaaaggacaacttcactgaaaacatttatgaagtattcagtaatgttttaacttctttttaatgagaaacagcaaaccctaaggggaaacactctggggtgtttatgtccagggtcagcaaggctccagggttatgtcttattcagacatattcaggagtaccggggagagagaatactccaggaaataggtgttggcatctgtggaaaggagagaaagtcagactgtatcctagagtcttagggataaatatagagtggaaaacatgaaatcatcttgtgaacacagggcagctattgaggcttggcaggtaggttggggttattgtgaaaaagttcccagcaatccaaagagatgttttatctttgacattgtgccgcctgtgccttgagttagaaaggtacacacacgtgtgagttaagaaaaacttctgatactaaattatttatagttaaacctctagtaaaaccctgaattcaaaaatatttgtagcagaatacaaatattctttttgttttgtcatttatcctggtaaaagtcaagttgctgcagcgtgatggttctggtactgaaatggtcttaggaaagtggaggaggagtggagttacatgtttttaaaaacttgttttgtggctgcatagtattccatggtgtaggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtgggggtaggggggagggatagcattaggagatatacctaatgtaaatgacgagttaatgggtgcagcacaccaacatggtgcatgtatacatatgtaacaaacctacacgttgtgcacatgtaccctagaacttaaagtataataaacatatatatatatatatatatatatatacatatataaacttgttttgtgaattttgaaatagttttacacatacataggcattgcgataatgctacggacagttcccacagtccctgttacctagtgtccatcatggaaagcatataacgtaatcatagcacaattatcaaaaccaggaaatcaacattggtaaatgctattaactaaaccatagatcttttccagatttcagtagttcttacatgcaatcattttcctttatagcatatggttcactgaaactttatcacatgtatagatttgtgtaaccaccactacaatcagaatggagatctcttcaatcatcccaaaggaactctttggtgcagtccctttgtaatcttgtcctttccccaacctaatgcctggcagccactaatctccatcattaaaaatttgtcatttcaagaatgttatatgaatagaataataactatgcaaccttttgagattgactttttttcccattcagcgtaacacctgagatttatctaagttgtgtgtttcagttgctgagtaagattctattttatggatgtaacacagattgtgtatccattcatgtgtgttgaagggcatttgggtttttttcccccaatttggggctattactgaaattatattttactgttttttcctaaatatatgaatctgaaagtgtatctgtatcatttaagacttaactccatgtggaattaatttctagaagcgtgaagaacaggttaccagttctcccaggattgctatgatgactaatttttagctgaataaaatatgaatatatctattcatttttatatgtgtcaagaatgtgctgagagttataggaaaacagaaaggtaataattgttaccaaatcatgaggagtgcccaagttctaaaaaacccacaaagtcaaagaatggtgcatggctatagtttcagaattattttctcagagagtgccagagccaatcttcttggtacctgagggtaaacacccaacctcttgttcctcacttagactttcttctatacttggcttttctccatgaagggtactgtttcagcacattggacagaaaaatacaagcacagtgcaaaaataggtgtgaatgttgtactgattcaggtaccagtatgtgttttgaaagttaactctgcttttctagtgatacttactttggataaaacctaggtcaagcctgttcaaaactgttacccgaaggcaattattcaacattataagcacatggtttccagatcattcatcattttatttaacttcttgagtacataaagtttttatcccatttgtgagtcttgatgcacacaattgactaactgtgtttgggttattttctcttccacattgggaaaaactatctttcatgatctatctcccttttcaaagctgttaaacttttgtcttctttaaatgattttctgtgatgatccagtgtttcttgtcacgtttctgtacctatatgtgctactgttgtgtatttgtttgttcatcctgcctctcccacggaaagacctgtcttctgttcttcgtcaccaagactctctacacagtaagggctccatctgttttgactgttgacctactgaagggacatgcctttgcggacagattcaacacaaggttgaggattaaacccaggcttattttccttcggattttctcaacaatccttccatctcctagtagtatctattctcttctagcaactttttttttaaataataaaattgccttggtcttctaggaccctctgggaaggtaggtgtcaggatggaaagtaggttggtctgatcaagggagtcctgtcatgggaggtgagaagacctgggatctggtactggatttgcttctcactcctaacatgatcatgaaaatattttctgcttccttccttattagcaaaatcaggtagatataaaaggctctgaagcagactgggttgttgtaatggcaaagggggaacytaaaaaattctggactgagatgtgggagtcacaccattgtccactgcagacataccaaacaagccaccttaatttagagcacaggcttgtgagtctagtgatgctgttcaatcatacattttaatctctataaaatgtaatctcctatgcacaaaggtagtaccaatagcacttgagtgcctcgaagagagttttgcccaaaaagcagcagacttactgtatgatatgtccatctgtgaaggtcctggctcagactgagctgacagtatggaagtctactctaatgcagaaaggttggaaacctgtaattattgttaaaagtttagggttgtggaacctatttttatagcaagacaaacttgctctggtattggcccatggatgggtaaaagaaagtaaatgctttcaccttttaaaaaggggaaagtgtggcactgtcagcatggctcagtgctcactgtcatcctgctgctacatcatgtgcttgatgcactgtcatttgggtgataacatcacatttaagtcatgatcatttattcccagtgtcagagtgaaggagtcctgttcatttgagtttcagtattcctcaaactggatttcaaaaagaatttcttccaaaagaattcatcaaggactaccgtaatttcataccaggaagaaaactgtcaaaatatgtcatgagtccaactaaaaacctagctcaaaccatcatagtctctcatccaaactactaaattgacttcctaactaggttcctgcattgactcttgctcctccatagtcggtgctccacacaacagccagagggatcttttaaaattaaaattctgttgaaaatataatacccatcacaaagcctttggcagttttctcttagaagtgcatgcttttacttagcttcaagcaatagtatcttctacctgtaggtcttctctctccatatataagtccttcctatcttttcaaatccagattttacattcgaatatccttcaggagatgtttaatgatccccccagctgataaaagttaccttctctgagttttttatgacacagtatttgtatattttatgccatgtatcagttttctaccttgtatcatagtaatttacgtaccttcatcctttctctactttgaatttattgaggacagattctgtgttttacaaatctgcattgggtactcaataaatatttgtgaaataactaaataaatgagctgtgttaaaattaaaaaaaaaaagaaaaagaagtgcatgcaataaaaatggcttgctatggctcacaggaaccaagtgtgatctggcctgagtcagtcttttcaacttcccctcctgccactctcccctttgctggctttcctccaagtacactggggtttttacttttctttggatcttcctcagggcctttgcacttgtggttgcctctactgggcacttcatattcccccagatttttgcctgactcccctacttcatttatgatcaacatgtaatcactccctcattctttccttattctctatcccttaccatgctttatttttcttcatgacccttatatatcttagatcataatatatatttatttgttggcttatttcctgccttcctgtctagagtgtaaccttcttgagagcagtgacattgtctttttcatactgcatcccatgcctgtagtgtctggcacagaacaggtttttgattaatagtctttgaatgggtgaaagagaatagaggtatctggcatagtcgggggtcaagtcagcctgaggtcaaatccaaatcttgtagattcgggatattaatcatttgttagatacatagtttgcaaatattttctccaattctgtaggttgtctcctcactctattgattatttctgttgctttgcagaagctttttatttaaattaagtcccagttgtctgcaaggaacttagacaagaacaacaacaaaaaacaatcccattaaaagggggctttaaagtacacgaacagacatttctcaaaagaagatatgcaagttgtcaacaaacatgaaaaaatgcacaccatcagtaatcagagacatgcaaattaaaaccacaatgcaataccattttataccagtcagaatagttattattaaaaagtcacacacacaaaaaaacccaacagatgttgatgaggatgcagaaaaaacagaaccattatacattgttggtgggaaggtaaattagtacaacccctatggaaaacagtgtggagatttctcaaagagccaaaaatagaactactattcaatccagtaatcccaccaccagatatctacacaaaagaaaacaaatcattttattaaaaaagagatacctgtactcatatatttatcacagtactattcacaatagcaaagtcatggcatcagcacctaagtgtccatcatggaggactggataaggaaagtgtggcatatataccacagaatacaactcaaccgcaaaacagaatgaaatcatgtcttttgcatcaacaggtatgaacctggaggccattatcctaagtgaaagaactcagaaacagaaagtcaagtatcacgttctcacttatgagtgagagataaacaatgggtgtacatagacaagatggaaataatgcactctgaggaccccaaaagcacagaggatgggaggggtttgaggtttgaaaaattacatagtatgtacagtgttcgctattcaggcaatggtcacactaaaagcccagactcaccactacacagtatatcaatggaacaaaactgtacttgtacctcttaaatatattttaaaaatccatactttggccgggtgcggtggctcacgcctgtaatcccagcacggaggccaaggcaggcggatcatgatgtcaggagatcgacaccatcctggctaacatggtgaaaccccgtctctactaaaaatacaaaaaattagctgggcatgatggtgggtgcctgtagtcccagctactcgggaggctgaggcaggagaatggtgtgaacccaggaggtggagcttgcagtgagccgagatcatgccaccacactccagcctgggcgacagagcaagactccgtctcaaaaaaaaaaaaaaaaaaaaaaaaaaaattcatactttactagtgggcgattattggaatatgaagcatttcagtttaactttgtaagctttagtctttgtgttttaaaatgtgtctgatgctgtcttcttcatagtttgttaggagcactaaatgaatagtagaaagcctgccagaaagtgatttagtctgaatctataaagctgtttctgagcactgactgtaaagtgcactagaagctcaaatttttaggttttgtcattttgtgacaggttgatgtggaactcgaggggttggccaaagccctcagagggttgtaggccatgaaagttcgagaaccactgggccatgtccatgcaaaatgaaaaatagttaaattgaaaaacagatgtccttgtgcctcctaattcccagcaggggctcttgtctgaagcctgagatggctccttgggtttctgtgaatgttgtcaagggcgccaaggatgccggacttgcatttagatgcccaagcctctgtgctggaaatgatgggaaaaaataggaactcttgaacttgagcaagtattagaatatgtgaggtaatggagaagcctcctccctcatgcccatgctcttgtcaggcctgtttgttaaggtccaggccccacttcccactttttttatattattattatactttaagttttagggtacatgtgcacaacgagcaggtttgttacatatgtatacatgtgccatgttggtgtgctgcacccgttaacttgtcatttagcattaggtatatctcctaatgctattcctccccctccccctaccccacaacagtccctggtgtgtgatgttccccttcctgtgtccatgtgctctcattgttcaattcccacctatgagtgggaacatgcggtgtttggttttttgtccttgcgatagtttgctgagaatgatggtttccagcttcatccatgtccctacaaaggacatgaactcatcattttttatggctgcatagtaacagcaggttctggagaggatgtggagaaataggaacacttttacactgttggtggggctgtaaactagttcaaccattgtggaagtcggtgtggcaattcytcagggatctagaactagaaatacacgtatgtttattgtggcactattcacaatagcgaagacttggaacccacttcccacttttgtttcctttaattgcccttatgagaccacatccaaaatcccaagtcctgccaagtgaatgcagtacttaaagatttgactactggatgtctggtcttggagaaaacagtcaagagctggagcaagacagagagcagcatacctgtaatacagcttattaaaataatgcaaacacttctgtaatatgtatgaggtgccaggtagtctgccaagaacttttcatctattaatttgtttagtctttacaactgttcactccacttcctgttagggagatagctgttgttggacccaatgtagagatgaggaaacactgaggaccagagagtaggcatccaaggtcacagagttgggcatgcgtggggcagagccccaggctcaggcattctggatcccaggcccatgtgcctgcatggtagagggggagctggcactagcccttgtgcccccaaatatcctggctgcattgttcccctgttcttagttcatttgtgttactataaaggaatacctgaagctgggtaatttataaagaaaagaggtttatttggcttggaggtctgcaggctatacaagaagcgtggcgccacatcatctgcttctgatgagggccttaggaagcttccacccatggcagaaggaaaaaggaacagatattacatggtgaaacaggaaggaagacagagcgggggagatgccaggctctttttaacagccaggttggcagggggtgtgtggggagactcttgtgggaactaatagagtgaaaactcagtcattaccttgaggatagcaccaagccattcatgagggatccacccctatgacccagatacattccaccaggccccacctctaacattggagattaaatttcaacataaggtatggaggggacaaatatccaaactctattatccccataaatggttaaactccgggagagacaactatgcacctctcaatcccaaggtgagttgggattcacgattggttaaaacttcatcagaaccatccacattggaaatcacatctaaaacttgagtaattttatggtttacaaagcatattgacttccttgatttattcatgttgccagctgccctccgaggcagaggatcttttcacttttctcctattactcaatgccactactgagcctctgcactgaccctacggcttcctgtcgtactctctgcaatgctacatgtcccttctagtctagggcgatcctggtggaagcatgaagccagccagcctctctctggtcaccaccatcacttcattccttatatataccaggcatgggaatgtttcttttgcttgttaatttttgttcttgctcttatctgcatttatcttccttcccccaagtgtactgccagaccctggagaacagggaggggaattgtttttcctttattattctttcctcagttcctgctgtagaactgtacatctagtcaatgcttaataaatgctggtaagttgaattatcaacactgaacgtagaaatgcactgttgcctggcttgttagttttgtaagaatagggataataatagtagcaactaatgtgtacagatttgactatgtgacattatttaagggctttgcacacattaatccatttaatcctctccatgacctaaagcactgctatgctgaagtgcattttgcctatggagaaatgactggtttttgggaagccaatgtgcagaaggccttgtttcactacccctaaaacagtgcatgtgcaggaggactgttattgctgtgctttggaaggtctgtggatgaggaaatgtagaattgcagatttatgggttggaagttgatttagaagacacatgtaacagaagtaacaatcttatcagacttaccagtgtcttccacttatttccttwacttcagatgctcaggaacgacagcacytgcagaatgcatccactgctgaaaaatgagagctgtttcttgttggtactcttcagggacattttagcatagtggtggactccagtgttgacttttcttttcatcatctgtttgatcttggtggattcttaagaatctctggacctgagtttgttcatctgttgattggggttcatggtagccacttctcaaggttatgattgaggtgaaatgagatgctatgtgtgcaaaggacctggtagcaagaatgacatgggaaggagggcttgctcaataaacattgcctgttatagtgtgctggcattaccttaaaatccttaataagctgtaagttttggatgagagtcagaagtgttgggttggtgaagcattttgctacagattgcaggcttttctccggtgtcacaaggcattgaaaacgcttgttcggagacagcccagaagggaaaaaaaaaaaaaattctggaaagcctggcattttgtgctatgttgtgagtaagacatttatagttattgagccaaaatttccactgtaatagaaaaagcagttgcttttaaacttctggtccaatttagtaattatgggtgagttaaaatgtaggccatttgaattggatttggaggatcaagtaagattctgtcctacagtggggatgactcatagaggaggtagcttgacatagtggaaatagaagctgataaggagccaggagacccaagttcctgtcctggatttgcacaaataaactgtaatagcctttaggcaaattattaaacatctcagttttctattatataaaatgagagggctgtgtttgtgaatggatctttcaacatgcttaaggttataccaaacagatcactgaaaatgaaatatgttatctacagtcattagggaataaagtattcttgctagtgcaatatacttatttggagaggattacaacataaacaagaaccaacgagaatacatcagtgccagaatgatacagacataagcagacacctgaggctctctgatacccgcaggtcattgctatgtcctaggaaaacatagccatgctagttataagagttttctgatgatgagtctttataaacagaggatttactgggaactagagatggaatttttaaatgatttccatgttatggatgacctgtacttgggcttatgatagctctgccacatcttgagaaataatttattgactaaactcgagttggcaaatgtaaaaactcatttgggttagctagcttgtttacttgttcttggcattctttcttcttcttatttcagttgtaggcatgaagccacattttgggctgatcatctttataataggcttatggttttataacatcagattttgaatgatagcattttctgctctctgtgtttcctatcacctgtagaattaagataggtcaaatatggaacagatggattgaatgattccctagaattattcactgacattataagggtgcctcctgtggcacaaatagaaatatttctgagagttgtaaaaattaaatttttaaaaatcgaatccaatttttctattgacctgcgttagaatttctgagacattctatcttcatttctgattgattttcaattagcaaaggttcctgccattttaactttaaatttcttagttcccctttttcctccaagtggttaatgatctgtgaacaaatattggagcaaatcagagatgcttcagtgtacagtcaccctatagatatttctggtgtgcaagggagtgagctacctgggagatgaggaaccttggttctagtgttttctctgccaccacagaggtatgcatctttgaataaggtctttttgcctgtttcaggcaccattctctcatttgtaaattatgagctccattgatcctatctggcttcaatattctaccgacaattgagtgggaaaaggaaactttctctgaatcataatctctcaacttttcttttcataaattttcttaaagtggattatacctatctgtaagtggataacagcctccatttattatccttatttttatttggctttttttttgacttgcaaattcctttttggatggattagattgaaaatctttgggaggctcaatcagcccagacagatttattcattctttattctggatgaagaagaggaaatagtttaagatagatctgacatggaacattaatttgattgaagcctttctgtgtgaggagtaattgtagcatcttcattgtcataatggagagattagcatggattagattagcttgtgtacaaaggttgtacaaattgattgctgtgatttgtaggctgggctgatctttatagtcactggcatgacttcttaagcattatagtcatgatttctttcatgtggtttacatgtggcaacaagaaaagcacatttccctcgttaccaaaaccttgtgtctcccaatgggaacttgacatagactcaaaaacataagacgtgtacatataatattaaggagatggcactggtcatctggcctgctgtctgggatgacagcacacattggccaaagacagaagagttcccaaaacagatgttcagagaagatggctagaatactgttgaaatgtggtctagaataattatgaacataagcctaaaaaggtagccaagatatggctctgaattatagccagtcatgggattattatttaactccagtttagtatgtttcctgccaagtatgtgccagaccctctgaaacagaatctggtttttgccagcagtgcttagcaactctatattttaagtctaaattccaaaaaaaaaaggaagagtaaagaatactaaactgctttctgatgggagtaagttgtatttcaagtggcctcagaaatctttttctctagaggagactttctgtggctaagaggaagagagtgggcacttctcccctccactgaacccacctggacttggtctctctcccaaggctttcactgcaattgaaaggctttttcactgccctaggtctctctcctaaggctttcactgcaattggtacatgtgttcagtgactattagaacttaaatgatcactctcatcccacctcactgatctcattttccaaatttctccctcttgctctcccattctagggaatctggccttcttcttggtcttcagatgcactgaacatcttcctgcttgaggatgtttgctgccttaccttactctgctggaaagcaattccttccaatggtgcaggtctcacttccttacttccttcagattttcgctcagataccatgttattcatgaggcttccctggccaccccatttaaaagcagcaccccaccagcattgcctatcacccccaccctgctctgtattacctgataacactaatgaccgtctggcagattatatctttatttgcatatttattatctgtattctgtctttagaatgaagayagaggctttattccagtgactgaaacaatgcctgacatgtaatggaactcaataaataattgttgaaataatgaatgaataaatgattagcctttaatttgtattcattcgtacacattacattggggttttctagaagacagtatgaaaatttcacttaatttgtgactcaagtacagaaagaacgatagagatcagaggttcttaaacaactatccatgaacccaacgctgtgctttacaaaatttaacgtgcatgtgaatcgacagaggatctcgttaaaatgtgaactgtgatttagtagtctaaattggggtctcgggttctgtgtgtccgacaggctcacatacgatgcggatgttgctggttctaagattgcactttgaggagaaagactctaaagtacctgtggaagggattcaaggggttcacaaagccagggttatgaatgtccagtatcattgttatagcaaagaactgaagtgctagtttctagaaatttctggtttatgcaataccaatgaacagatcatttattggacattcattgcagagctttcaactgttaactatgcatggttgttctgtatgcagacataaatataggtataggagaatttctttttctgaggaaataatagaaaatattcatcagtttgtcaaaaggatcagtccaaacaatggtgacagccattgttaatggatgatggcattaaacaaaagaaactttaggtatcaaaccaaaacacatcataaccacatcgtaaaagtagtgacaaaaccaacacatatgtttgcaaataccttgggaagattgtgttttatagcaatagtttttttgctaaacaaacaactaacttttaaagttaacatttgctggagatgatattttcccagggaagtatttaaatgcttggaacacacctatccaaagacaaatatttgttttcccccagccactggaaagagaccccaactggaaacattgtctagaaatgaatatttggaaactctgaggccctctataaatgccattgcagtagctcactgtccttctaagctgaggccaaaatgccctcaaaggggccttggtgtagaaaagctgttttcaggcaaaaaaaaaaaaaaacaaaaaacacaacagcccatcaagagctgcatagcttttcagtcaggaaacttacccccaggtggatgtttctcagccaaggagtgtgggcaatttagtttcaaaagtaatttggaacaactgagatgttttatattaaatggtcctactaaatagacatctagcacagggcttagccaaattctagaaggcctcgcatggtatggtatcacgatcctcataattgctaaaaatattactcataatcataatggctaacaattattgagtctaaatatatgctaggcaaggtgctactaaccttccatacattttcttatacaatatttataaaactaattcggatggtactataagtttttttgttttgcagaaaaggaaactaatgcatggatatgtgatttatattgctcaaggtgacaaaattgttgagttgtagaattgggactcaaattcagatatgctgattccggggctcatcctgctaatgactgtgctgtactcataatcataacaaattgatttttggtgaccttgaaaccctgcttaggaaactaaattttaagattttggttgaatttaccctcagggtggagaaaacacaggttttcataaacttactgtcatcaaattaactatcctatattatttttcagaataaacactcactacttgttaaggaaatcatggtgaaacttattcatatgagctaagagcttctgcattcccatttcatggaaacgtggattttccacgtgtggctctgtagcatggcaaaatagcttggtgtgcaaaaataccctagggtaaagataaatgtaattgtttttgaaatcaaccacttgtccctaatgctcaatctgtgcttctgagaatttgccgagtttcaatgctttaatgtgtgtattgaacagggctttctgttgcaaatagcagaatttgcacacgctagttgaatcagaaaacaataacgtaacaacagatactaataaacacgtagaatctcrgagagtgccaaagagcagggttctggggctacacagccacaccttaggacttctctctaatcatatgacttctcagcacctgtgatgccaggacttggcctcccaaagctgaggaaccaaatgcctcaccaactgctcctgccagaaaactggttctccctggtttggtgcccatactctttgaattttctggctttaaaaattggactcatggtgtgagaaaattccaaaatgtaggaagatcttcaaagatgttgagcagtcaccacgaggaagcttccaatgttgtgtatttcagatcagtgttgtggagtatctttccctttatcacacttttccttcatttttactccctttgattgctaaatctttacagagagcagggactctgttcattcagtccccagaatggcaatgtgttaagtccacaagaaggcttttcgtggacttttggagtctgatcataaaggagaaatatgtcttaaaaaggcagtggaggtgatgtggtgaattttgtgcttagcatttttaacttgagaaaaatgataagacaggccagtcaacacacaatgggcaaatggagataggtgactgtaattcagaagtgcacacaggactccaggtttgagtatgggagttgtccttcaaggattggcagttgaagcattcaccagagcatggatgtgttttctgagcaagagctgtcaataattaggatagaaaactgaacgtggaaccctgaagacctctcaccctgtgccaaagtccaggtgcagaaaagaaaggtgagcttgtgataaagagcaggcagagttcagaagacagccatattattttggtgtcataggggttaaaggaggcaattcatgagaattgattgcttttttctcactctttattgagatatagcttctcaaatgtaaagcatgatttgaaagagatcagtaacaacagttatgcattacatttgaggtgtgttttgtacttttcaaatttgttttcaaatccccatcacttcatttaacttcattcagacacttaaattgaaaattactttctatgtgtggttaaaaaaatcttgcattatttttgtttttttctttaatctaacttaaacatggaagaaaattcagttgtgtgtagttaatcacaggtttgaagaaattaccttaattctattttgagaaagaaagagtatcatgtggtatacagagtgaaggcttggatacctccgttgcacaagtttcctgcttagctgggacctggtcaggccacttcacctcccatttaaaacatcctttagaactaggtatggagctaatgttttagatatgaaaaataattattcacagcgtgttactataaaacatatgttcatagattcttacatttgtatacaaaacaagaaatcacaaagctttattcatgcagaaaaaattaatttgaaaaagcccactgtatgccaagaaatattcttgatgcttggaggtttggggttgaggtagcaatggggagataaaatgaatatggcttgcttcttgctttctgcaaagaattgagtttcgattctgacttaagagacataaacaaggaaaagtacattctccatgctgcatatgtgtggcttaggccctggcttgatgaagggagatttggtattttgttaatgtaggaaaaactaaaccaaagtgtcttttctattctctcatttaacagtagtcaacacagaagacttctgtgacctctagtcaccaagaagtgtgtggggatttctcactaccaacaaataaaccatcagttctgcagctgacactagctgggtgtcctctaattcaatgctactctgacactgtctacctggagatacagtcagatccctcagcttgagagctcagtccctaagactgtttcctcccctcactgcagatgccagtcacaagctccagtttgttgcgtctgtgcttccagccagctggctataaattggggttccctcaacttcccccttgggtttgattaagttggtagagtgattcacataactcaggaaaacacttacttacatttaccatttaccagtttattatacagaatattgtaaagaatacagatgaagaaatgtgtaaggtaaggcatgggtggtgggggacagagcttctatgcccttcctgggtgggccgtcctccaggaaactctgtatattctgttacccagaagctctctgaacccaatccttttgggtttttacagaggcttcattatataggtgtgattgattaaaccatcggaccctggtaatcaacttaactttcagcctctctccatccccagaggttgtggggtgaggttgaaagttccaaacctctaatcatgatttggtctatccagtgaccagcccccatcctgaagctacccaagactggcagccagcagtcaactcattggcatacaaaatacatagtttggaggctccactgattttcagtgtggtaccccaggaaagtggatgaagaccaaacatgtatttcatgaagccttctatttcagtagtaagaaaaatactaaattataatacgaatttttttataccagcaaagcagttgcatttgcatctttaaaatgcaagtgcaacttctttttagagatctattgcattttaaagatgcatttcatcacttattacagccaaatgacttgcccaggcattagattttctgttgcagtgatagcagggatttaaataatgattatcttctctttgacctggtgaatttcttattaccctgcatatagacatggttggattgtactgactttgcaaataccacacaactgaagttggatttctgttgtccttcaatcaaccatctacctaagcctcaaaccgttttgttttgcttaaaaacagaatgagtttggcaaacctagaaaagtacacaaaggatcatccatggatataggatggaagatgtatgaatatggaccaacaacagtgtttattttaataattctaatattgttataagttgtcataagcttaytttcgtaattagagaatagtcttcaatttacactgaatgcatgtttggcaaatatactaatgttatatatgtacttctcttgttcagggcagtcacttgttttaagtaacatgtttatctttattaaaatatgaatttcatgcggttttacagcaaggttattggttaaatcaatattctcaattaatgaaactagtgacatcatcatcaagagcaatagctagcatttgttgaatcctgactatgtgtcaggcattattttaatcacttcatatattttaactcatttaatcttcacaatggctctactatatagaaacatgtattaacccaattttgccagagggttgagacacagagattttagggaacttaggcaaagttacatagctagaaattacagtcagtgattgcaaagcttgtgctcttaacttctattttatcttgtatctgtaaagatatttactaaccaagttaagtgtccttagagcatatttttatagtataaaaattgggaaaaaattaagataaagaaaaaaacccataatcctactgctgaatgagagctctgttaacattttgaggtacacatatttaggctttttccctcctttacatacattcacataatttgtattataaatgctcttttaaattaattttattcaattaatatattttaaaactttccccatggtattatttcattattattttaaatggctacattaagatatggatatttaggcttgaaataagtttaaacaaacctattgtcttcttaaatctccagtcatatttccatgaaggatggcagctcttagaagtcatggaagcaaagaacagtacccctcaggaccattgtaagaaaatgtcttctttgagagttcttaagactattagcacatctgaggacattttcctaaggattcatcttggtgtaaggacacactggggatattttaatttgtagtgatttgttgttgttgagcaataaacagtatatacctcttgaatttgctaaggaatgtgtgagcatacagtgctggtaacactacattagttaactctctttacctttcaaaactgatttaatgaaggtattttaatgccgtttcatagataagaaaatgaagtgcaaagtagttaacttgactaacaacaagtaagtgaaggagacataatttaagctttagcacagacaatctgtctcttatagtgaggcagtataacaataaatatgtggaggagatttctaaaatttccagtgtatgttaagaaaacaatgtattttatgatgttttagagaactgcccattataaccaactgataatgaaattcttcatctttccatgctatcatatttttcccttgtcagcacactgacctaggaatcaagaaattttggttctaatactcgcatttccacctttctgggtctcaagtttttatctttaacataaaaggttagaaaacttgaaaatcttaaagtctcttcttggttcagagagattagctttatggagttgtagagcctgtgtagaagctttataaagtggtttagagtcaattgacctcattggagaaaaaaagtagtcagtaagttcttcacctctgcaaagtgcagactgaatgtggagaacagaattgttgttttcttagctgtggctgtagcaggctgttactgattaccctcataagatgttttgaatttgtcttggaggaggtggctttcagcctgactttcaggctggctttgggtcatcctgagtaagaacaagactggtagtatatgctgccaaatgtaaaattatataactgcccaggagagctgtcacacgtggaggatactagaggctgccatgacaatattagccaaaaaatgataaaccacaacgtgatagaaggaagaatcctcactttatagttgagccccgagtaagtgaggaaagttgtgcaagtttgtaacttcagtgtgatggttgaggatggaattaaagtctcctgactgcttatgaaacctcccacctatatgtktttacgcaaaatgtcatggcccttacatccttttgtttccattgctatgatggttctggattgtaatcctataagaatatgatcacttaatgaatttatgttcattatatttcatatgcagcctgaaatgcctctggtttctttattagcaaatcaacagaaaacacttgataaccagattcaagattagacagcaaagatctacagaaacagattaatatcattttatggcatactatgatctttttttagggaattaactaattactgctcaaggaagcatatccaataatatgcgggtaaaaggatataagcaaaaaggtagcagtaaatagctgtgttttggattccacaaggcttgtgttaggtgaggtcttattcagcatagttatgatgtggtaaagagagtacattgcccactaatacacatttcaggcattataaattgggaaacttgcaaatgcaaataagaaaggatgggtaaaatcaatatgcttagtgaagaagggatcttaagaaatttttttagaaaggatatgggaccctaaaactattgaagtaacaagaaattaggacaagaaactaatatgggaccctaaaactattgaagtaacaagaaattaggacaagaaactaacagtgatagaggaagggtactggcttgttagatttgggctcaccgtttggcaatccatctctaaacccyatcacaacttatttataataataatcttggtgctgatcatcataatctgggtatgcagatttacctacataattttaggcaaattggttaacccctctggacatttaattcctcatctgtgaaggagttacacaagaatacatttattggtttaaataactactgttcaatagagaatttttaaattagcatctgtagctctgttaggagggaaaaatgatgatgttttatgatttcaacacatgacttcatttctttgagctatgtgacagtcatgctttcctccattattcatcaatactccccactgcttaaagttgcaaatatctagggctgggctacacaaagggaactgagagatagcccacccttccgtgcaaattttattgataagagtgatgtggtccagagacatgagacaccttgtccaggggtggttaatggtggagcctgaaggatgagcaggtcatgattctcagcacagaactctttttctcttgtagaaaagatagcaaataggctggatgaggtggctcacacctgtaatcccagcactttgggaggctgaggtgggcggatcacttgaggtcaggagttgagaccagcctggccaacatggtgaaaccctgtccctactataatagaaaaattagccaggcatggtggcatgtgcctgtagtcccagctaccgggaaggctgaggcgcaagaatccattgagcctgggaggtggaggttgcagtgagctgagatcacatcactgcactccagctgggtgggagagtgaaactgtgccaaaaaaaaaaaaaaagaaagaaaaaaagaagagatagtgagatagtaaataggttttcctcctcatgccaactcagatcagttgatagtacctgccagttgagaaaatttgtaaggacgtagtacctaggtactacataaaacactattgctattaataaataattatcactatcagtaattattcattagtactgtctgctatattaacaccatagggaaatagaaaatgtttgccacctcctatcaagaatattctttaaacatattccttcaagataaacgttcaatatttattctgcctttcttgtatctctgtcactcacaatattacctaatgctatctaatgtattctgttcttagagaagtaaaatgtctcagtagaccaaacttagatttgatcattacgaaagatgtcattctcagtggctggatcttcatgaggttttcttgagctgtttttcatttcacctgctgctggatgttttaggctgctgtattcrcatctggtggcctgtctcactaggatctcatggctgcccgggcagtgtcacagctctgagttcaggttggctctagtcttgcccttcgctacagaatcgtggaatacagtgggagatgaagaaggcagcactcttgccctttgtgtttctagtaacttaaattcaactcctggcagcctacttcacattctgatttgggcttctgatgttgagtgctgagggaagctttctcccactgcttacatgttctagctccttggttggctccaaggagttgtgatggaatttcttggcatacttcaagccagcagcagccaggttggccttttccctccacatcttatagctttgtaggattttgggagaaaactgacctggaactagttacatgacctttttcatttatttgggtcttagtgctcatccttgtcacctcttattatttagaatgaaaagcacattactctttaaggaactagagtataaattcagaaacctagaacacatatattaatacacagaactttttctcttttcctagctgttcaaatgtaatacagttttatgttcaaactaaatgaatgcctatttattcctggaagtaaattttgttattttctagtccaggctctttgttttacacatgacaaaatagaagcccagtacacaggagggttgaatgacttgtttaatggcacatggccaaagaaacagaacagaaaaaaagaaatcagaatttgtcagttttctgtctagtgcattccaaatcacatgacacaaccattattggttttagaattggaaaagtttggtttattttttaactgactactcagattttaaaaaaattgtttcattaatagattagtaaaaatttaatactgctgttcattgtagggcttagtaagccattactatgatagatctttatttttgttttctttaagtctgtactggacattgaagtctctctatggtctctggacttacgtcttggccttacagactgtcctgtttcacctttgcctcagtctttgcagtaatctccctcactgagaagtctggaacatgccacatgttcacagtgaggctgttaaaacttccagccccatccaaaacctagacttggaaaccattgtcgcattgctttctgagtccacagatagcaaatgtgacaagtcaaaaatgatgcctaatgttgagcaaggagtctttaaaaagccctactcatgtttctaattctcacacccatgtaattcacaggcatctgtccacaggtagtttgagaacctaactatattaaatttcaatattcagcaaatagctcataaccaatcatatctgaattagaaaagcatgtgtaaagaacaatagcaccaactagcactcatagcagattattccagctatgttataataaggcccttggcaataactcaaggtckgttttttcaaaatgtaaggattaggtgttcttgaggcaggaaagaaaaacaagactattctttgcagatggagaaaaaaatgaagtagattcactagcagagtcactttcatggaaatttggagctctgctgcacagttttagtgtttaaacaggattggaagtcctttgggatgacattttcaatgctgaaagagaaacacctgatagaattgagtctcaatgaaacagaaaacctgctgaattgaaaaggggcttcactcagtgactaattttctaaagtgagtaccccaaactgttaataactattttaaagcagttggatgactacattcaagataaaaaattatatgggaataaaaattgtcaatatatctgattttggtaaaactaagcacacaatttaaatttatcttggaaaaccttagtagttattggaattacttgagaatctattgcaagcaatctaaatgaattcttccaaaacatgtcactggagcaggtactcaagaagtaatctgaagtaaacaaacaaaaacaaagctatatttatccttcctcttttctgtgtaatayaatccatgggaagacaagaagaaatttattttctacttgtgagatttggggatgatgatgctttttctatccttatcaccatttgtcaagatacaactttcattactttccagtaccacctttgaacagcatcttcttttttagtatattctcccttcctccttccatctctccattctttcttccctcctcttttcttcccatatttccttccttccttctttctttcattttctctctctttggaatctcttctcttaactttatgttttccccaagtgatcagctgtttttatacttctctgctggttcctcctaacagagtctttgcagattttaaagtaaaaccataaagaagaaaacataaatagaatcttcagtgatttcacagcagaaaggcatggtttgtattactttctctcagaggtatttttaatggggtaaatatttatttccagatgacccaaatctctttgttatgtttgctgacagaaacagcagctcctccttctttctctctacagtaatgagattatggacagggatagaccttcttcatactgctctgacaacagacattttataaaccagggacgggctatttcaattcagtttaattcaaaaaaataattattggatacttaccacatctaggatattgttagctgttataaatgatacaaagataattaaaacattgttcttcctctcaaggaatttgtaatctagtatgagggaaactgtgtaaataaatatccaatcctggatgactgccacaacataaaaacacacaaatgtttaggaactcggtagacaagcaaaggaagtagaatagtaaagatgaatgtctcctatttgtcaatattttacttcacctctgtgttgttttgggatatatcaaataatgtcttttaaatttagagttattgttactttataataattattattattgtcataggtagtgttaggttgtgtcatttatgtaaatacttatggagtagtaacatgatatagtagtctacctcagaaagagatttattgagtctatgatgctgaattatagttttgtaatatgtttctaaattctttatgatggagtcccactctatcacccaggctggagtgcagcagcacaatctcagctccctgcaacctctgcctcctggattcaagcgattctcctccctcagcctctcaagtagctgagattacagtcatgcgacaccacaggcagctaatttttgtatttttagtagaggtggagtttcaccatgttggccaggctggtctcaaattcctgacctcaagtgatacgcctgccttagcctcccaaagtgctgggattacaggtatgagccacggtgcccagcctgtaatatatttcattccaacttttagatagcttctttatcaggtgctgcaataaattgtttgccctagatcgaggtggggagagagccctcttaggatgagctgtcacacagtaaaagataagatttcctggatcagttttctaaagtgacaggcgtgtcccctaatcgagacagacagtgctccattttgacaaataggccagacttctacgtgtgcatatttgttttgtgtgtgtcasagtgagggtgaggttgaggagtcattctgttcttattggaagtgaatcaggcataaaagtgatagagcgcttgaatgagatgattgcagttgaaagacacagcaattaagcagatttcagactttagagagcatgtcttccgggagctatccacggtactgaactgcttctccctatattgtcctgtaaccccgcaaaacaaaccttcaaacattttaaaaccacaagacattttaaaaactggctttggttattccttackagacaaattctctaacctgtgtatttctaatacttgttatttgtttaatcttggctaggtcarcccatttttttttgtttgatattacacattcatccatttatttattcaacaaatatgtaggtacaatcttccgtatgttgggcagcctcctagtggttaaggtgcttaggtttcttattatgtaatgctaattattattacttttgatttttctgggatttactctaaggaagcagatttaatgattaaaataattctacttcgtgtgtgttgtttgaagaacttggtttctggcccaaagatgatgctttgtttacagtacctagaacagccctttggcgtatcgtagacactcaagaaattgtattcacagcataaacatgtttattgttgtggagtgattttctatgaaatgttacaaggaaaatatatattttaaaccaacaagtaatctttgcaaaaaaaattttgaataagaaaaatattgttctaagtaatctagatggagcatacacctagccttaaagagtctagaattgacatgttgggacattctcatatgttaagaccacattacaggttgaccagaaaactaggaagaaatagaccagatacttcctgctcaggcttttatgtgcatatagaagctcagtgatctttttattctgttttactcaggctattctgtattcaggtaggatatctatcacccttactcttctctaaccccatcttaaaaaacaaagcggcggggagtttttcttttgatatcagcaacagataaccaaataagatggcgtataatcctttttttttttttttttttttttttttttttttttgagatggagtctcgctctgtcaccgaggctggagtgtggtggcactatctcagctcactgcaagctccgcctcctgggtccacaccattctcccgccttagcctcccaagtagctgggacgacaggctcccgccaccacaccaggctaattttgtttctgtatttttagtagagatgggggtttcaccgtgttagccaggatggtcttgatctcctgaccctgtgatctgcctgcctcagcctcccaaagtactgggattacaggcgtgagccactgcgcccggccagaaggtggagtgctattcttaactgtccttttgtagttctttgttctaagaatttggaaagacaagttagtcctgacttccatggaaatgttttttttccaaccaacatgggtgtaattctgaaggagaattctttcttaccagtgactcagtccctctgcagggcacagaatcaacagtattcctagtgtttgcaagatcagtgattatatagggtcagtataggcaaactctccatttccaatccgttgttaatgaaatgttatttttgggtgaagttctgagatagactgaatctgagcagaataaaaaaaagtggaatcagcctgagttctagcttctacccctatttctgtgatatgcttccttattgacatgtgggctttgaaacttggtaacatccaaattgtattatcactctcttgaaaatgtcattgttccatgaaattgtgagacttaaccatttttattgatatctcagagaaaccaaatcttgagaactaagagcattggaggataagctcctttcctagagatacttactctacttttggtcatggaccaaatttggagttattcctgtggatttttttctcttgttccttaaggcagtgatagatgcttgtttagtcaccataagttgtgagaatatgtggtctcaataaagacccagcaataccttgtttttctactcattatccagccccaaartttaagatctaaatgtttcctggtgagaatacaaagaaaagtgagctcttatagcctgttgatgggaatgtaaattagtgcagccattatggaaaatagtagagaggcttctcaaaaggctaaaaatagaactaccatatgatccaacaattgcactattgggtatttatccaaaggaaacaaattcaggatattgaagagatgtctcctatttattacagcactattatttatttatttattgcagcactgtatatttatttattgcagcactatttatttattgttaacactatttatggcagcactattcacaatagccaagatatagaatccacctaggtgtgcaagcatgaatgaataaagaaaatgtatgtatacagaatggcttactattcagccaccaaaaggaatgaaattctgtcattcacagcaatatggatgagtctggagggtatcatgttaagtgaaataagtagggcatagaaggataaatactgcatgtccttacttatatgtgagagctaacaaaagttgagctcatagtagtagagagtagaattgtggttattagaggctgtgagggggagggggaagaaaggagagggaacggttggttaaggaaaggagaggagaggttaagaggttggtgcagggttatagctgggcaagaagaatactttctagtgttatgtggcactgtagggttaaatacagctggagatgatttatttatattttcaaagatctgggggagaaggttttcaatattcgcaacacagagaaatgatgaatgtttgaggtgatagatacggtgattaccctgatttgatcattatgcattacatacatgtattgaaatatcactctgtatactataagtatgaataattatcatgtgtcaactaaaaataagagggaaaagtttcaaaacaatatctatttgttgattccatctgtatggcttagtgataatgtaatcttttgctgtcttgcattgttcccatactggatttcatgactaatatctttgcctttgactgatttgaataaaaatatgttaaatgaacagagaatcttgacctcctttcagaggctgaaggattccttaatttctttcctccatttgcttaggaatcagtgccattgactgtttgcttttagttaatacggttttgtttgcttaatacagaatatgtgcaatttaagtgtcatatgtacataataagatgtaatcttttaattatatgatatagcataattatttccattttatatatgacaaagttaatgtttaagaaagttaaataactctaattaggagtcaggattgagaatccagacacagatggctctgacatcagaatcactgctttaaaccactcttcttttctgcttgctttaatattcctttacttcctccataaagtgccacatcagaatatagaacaggttattaatggaagaaatatttcaatattttgagttttttgggtgaatgaaaattatagaattaaaagctgaacatcattttatttggcagtttcatcattatgatttaaaataaatgcagtttttgaagtttcctaatttattctcttgaaatatatttggattgccacatgctgtatattctaacacttggccctggtagggtttatttgtatatgtgtgggtgtactttaaatataaagatctcactgattttaacacacattggaaatatgcataggcaaaccccaaacaactttttattcaatagtgtccatgtatctctaaacttttgatagaaatttgttccaataatggggttactacataagttgaagaaagtcaaactgaagcaaaatttgaaggcttctatattaatgatcagttttaggcgatacttgccaaaayctagttcaggattagaataggctgtgttgacattttaagtgagacatatcagttactctttttcagaaagttaaaataaattctcataatgaaaaaataaatgataattttagattcttttagagaatttactacctttacaaattaggaaaataatattcacagtatccatgattccaaccagttaacatgttggtatatttctttcagttatacacatacacataattaacatataattatatgaatttatatataattttgcattctaactttctatttgacataataacagtcttattttgcacttttatgattttccaatgagatatatctattagccatttctattttttgagttgcctgtttttttgtgtatgcatagatatatgtacgcctgtatatatacacgtatgcatacatatatatgttttttgttttataaaaagagataccatatttctattaataccgtcacagctctgatccttctttctattgtagagcttctatgcatgtattaaaatttaatttagaaccaatcaaggaagaggtcaatctgaataagataatatttgtaaagttcttgcctgtattatgtatagcaactagagctactttatccacagcgatttgaagccatgttgaacctatacaggttaattgatgcaattctcttggaaacatcgtcatctgttggcctataatgttttaaaaaccttggaacagtctcattgttttaagtatatctcctagttttttcctttaatttgtttgatgatatttttattttcttaagatcatcttcagctgaatcctgacaaccctactacatgatcataacaaaaaaagcaatgaggagtctctataccctttattttcataggaaaatattctaatatccacaaatgtgattaaaggatagagcaggtggtggggcgaggtaacatctgatgtgagaacgaagaagcaaacagttgttatttttactctggtcaggtgaaaacaagcagtcattacatgtctaaatcttgggtatctttggaatcattttcagccaccgtagtaagttgtacgtgcttgagtgtttttaaagcatgtcttatagtgaccaaatgtttctaccgcatttatctcagtaaagttgacaggattctattaggacgatcttcacctaatgagataaatattctaattgtaatcatcctcttggaatgcatatctcttctgggaattaaaagtgctttaagtggtgttgctaaacaaacatttctaaagagtaatcataaagttaaatgcctcacaatagcacaataggctttttagttgacctggtttttaatacttttttcattgcaaaatttcttattctggaaagtttggaaaaatgaggaaaaaaatagaaagaaaaatgtcgaatttaaacattttgtcactacctagttaaaatcggggataacattgtgatttagatttctccagtctcctttctttttttttttttttttttttgagatggagtctcgctccatctcccaggctggagtgcagtggtgcgatctcggttcactgcaagctccaccttccaggttcacgccattcacctgcctcagcctcccaagtagctgggactacaggcacctgacaccacgcccgccaatttttttgtattttttttttttagtagagacggggtttcaccgtgttagccaggatggtctcgatctcctgacctcgtgatccacctgcctcggcctcccaaagtgctggggttacaagtgtgagccaccgttcccggcctctccagtgtcctatctcaattcytattcaattgtttgttaactagattggaatcatactgtgcatattgttttataatttgctgttttggctgacatttggaaaaattattttagaaaaaacagccagttttgtagatgaaatggtgttttgtttctattgatttttgatttttaagttgctattacttcatgaagttagcgtctttcttgtgtattggctattctcttttcttttgctataaattgtctgctacatcttttagttcataataattattgagtcattttctgtttaaatataaagtatttttctcatttgtcgctgtaacataatccatttttaagaagcagagcattttcttgacagagttttgaaatattgtgtgactttatggctagaacacagaaacattagttagaatttcagaatcatttgatcagctctggctttgagcctctgattctacttgtagtctccaaaccaatctttggtatccttctgtagagatgtaagttgttatcaccaactcaacatgaaattgtaagaatttataacagtgttttctaaaatgatttctttgatttattcaaagaaatattatctctgataatatatttcagtatttttcatattgctcaatatcagacgaaagttcttataaaagtcctgattgtttcagcagtgatttgcatgccattagcaggtcattcatccccttccactttgaggctcaagttctacactagatttgatttgttggagggagtctacaaactctgctttcactagaaagacatgatctgtgtgctttgctgccatagtgggcctatccacatggctcattctctgtaacactaacttccaggaaagctcttgtatcaaaattcatcaccggtattaaacagtgtcaattatttttatcacctgttgaaagcttaaatgccaacagaaatttgtgcttcacagggcattgggtcctccatttatatttttcaaatgtgtagtatactcttgcttttagtcgtctattacccagtgttcttttcggaaaatatttttaaagttaattatatactcacagataatagtgcaagcaagtttcctccatgttctgctttcctttttctgactttacttcatgctacattccttcacaaatagtaataagaatttatttctactcagaatgaatgttcctcacagtggagagaatttgccactacaaaatgccttctactctgtgtttaaattcctcgtacatacaagcaggttttgggtgttacatttgttcatagaggtatgaaattgagagtcatagattgaaatgttttttatagtagagactcccaaaaaaaggcacagaaaaatggttgatatctagtaggagttatttacatgctgctatttctgatgcttcctatttgtttcttctgaaaaagtcgcccttcctatgtctcaaaacagtacacctgtaaaaccacatcctactgggcataattctacaactgcttctattctcaatgcttgtgttgcatgcttttggaccctaagagaaatcagcaagctataaacccaggaccaagaagagcatatatctcttggaaaaatagcatttgagtgattgaataaaacaggctgttttggggatcattccaaatgcagggaacaatatggatctgtgatacttgagttgttggactttgtagaatatcaaagatgttctgcttttcatattcagatttttaaatagaaggaaataaacaatttttaaaatgtttggaattaaatgggggaggtcatctgtaactgtctttgttgatttttgtgggcatcatagcacagaagagttctcctggcttagcattctggtattgctcacatatcacctatatgctaatttgagagcgttcatgagtgccatgaaggatgagtcagaatgatagacagtatgctgactttttctcctcttattgaatttagtctgatctgctagtgagagaaataaaagggaaataaagcagggagtataatagggaaacctattttctccaaatgttgagatatttaaaaagtctttgttcagtgtacctgcagttataatctttccagagattcatgagatgtcagggctaggcaagactttagaattctatgtagtaaactcttgtttggggctgggaaaatggagggtcacagttagaataattgcctaaagccacaccgacagagagctggtagtggaatccctgttttctattcaccttcctactcagttgcactacaagtttatcctaattcaagtaagcttagacatcaccttgggtaactttctgatttaccaaatccactagtggaccatattgaatttgcttccaacatgaatactcttcatttctctccatccacactgctacccaccaaaatcccatgccttgaatgtaaataatcttagagctgatctgtttgcttctgtaacttcctgctactcattccataagcaacagaagaggcaaaatgaccttttaaaaagtataatttgatcattattctcctttacttaaaatcctagaatgacttccattgcacttaaaattccaaatttctttccatggcctaaagggtctacttgatcagtgtatcgcctttctctagaacttaatctacctctgacccttgtgtgctatgctgcagccactttggcctcctttcttttccccaaaattgaagacacatttccatctcagggcctaagtgtttgcagttagctctgtttggtgttctcttctcctagctgtttacagctttcagccttctgcagagatgttccccagctaccctgccgaatatcgcctttccccacccaatcctttcattaccctattttttcatagcagtaactactaattaattatgtctttatctattgtcttttcccagtctccaactagattgcaaagtccctgagggcagaggtcttgatgtcttttccattaacaatatctcgagtaaccaccagcaatctgcacatagtaataacctgaatattcctttaatgaatgaataaactgaaaaccctaaagttcagtaatactggcctctgtgtagagtttcagaaatatgccaaatatgctttcaagcatcccagcctgtctagtgtatcctttgctctcttggccttctgagatcacttttaattggcatcctctgaagttgttactctcagtcatgctggttgataccccgaatggataggaaatggataggcattttttctgtccatctctaaacatctctgattgggcctaatatacctctcaggcctgctcctctggccaggacccctctttttatgggaagtagggagacccaggaacacagaacctataatatattagaacctgttatatatctctctagaaaaaacagttattttaaggaacgtgattgctggggatggcaagtcagaagcctgtagggggaggcctgcaggctggaaactcaggtagcagttgatgctgctgttttgaagctgacttttttcttctatggaaagcctcagttattgctcttaaggcctgccaagcaatcggatgaggcacacccacattgaagattatctcctttacttgtggtcaactgattatagatgctaaccacatctaaaaaatgccttcatagcaacaccttgattagtgtatgattaaataatgggacatgatagcctagccaagttgatagaaaactacccatcccatcatgcatttgtggtattggagaaaggaaatgcttctccattgttactactgggactgttactgctgagacacaccgaagaggagaatttttagtttttagtttgctttttagcagaattcaaacttaaatataaaattaaccaaattgtcagaaaggactgaaggttatcctttcaattctgagttttttatgtaaaattattttattattagcaacaggttttgaaaacatttatcaattatattcttatatattggtgactttaggtaatgaataaatctggatttatctttctttataataaaaatatggtctgatcaaagtatataaaattgaaataaatattgtcttatttgtgctttaaattaattgtagtataatattaataggatattatataatattcagtcattttagaataggagaaacattttagggtaggataaacaagaccgtatcatgaaattggagattttaattgttttgtaatattaaattttacctctcatgaaaatagagtagataattattatggattatgaaacagcataattagttgtaacagttttaccttgaagaaaatatatcttttttataagcagaaaacttcattttgttttctttaaaatgaagtgaataccggccgggcgcggtggctcacgtctgtaatcccagcactttgggaggccgaggtgggcagatcatgaggtcaggagatggagaccatcctggcttacacggtgaaacgccgtgtctactaaaaatacaaaaagttagccaggtgtggtggcgggtgcctgtagtcccagccactcgggagtctgaggcaggagaatggcatgaaccctggaggcggagcttgcagtgagccgagattgcgccagggcactccagcctgggcaaccgagcgggactccgtctcaaaaaaaaaaaaaaaaaaagatgaagcgaataccatctctactctcaatgtatcgtggacgataataactatgctagtatttctgcatagtattcttaaagaattctgactgaaaatatttaaatgaaatacacataatcactttgccacctaatgcccatcaatcattgccaacattgacttttaataaagacacataaccagagatgatttttaaaaattatggataaattacattagaaaatttagctggagcaaattatatttgattattattaacctgccataatttatattcattaaattgccaaatcttgattataatagtcaaaaagaaaaggtacatgataatgatctagaggtagaacacatgctatcaactggaaaactaattgttcagcatcctaagtgtatttgttgcttaattatatatataatttctacaacaagtggaatgatttacatgaatgtcaaataactggtttataaatgaaacctgatattaagctaaataaaatattggcatatagtgttcacttatgagctaatattcttacctctagcttcatttacaaattarttatgctacaaatatattaatgttccacaactctttcacacttccatcaatatcgagtttattccattacaatgtgaaattaaaaaaaactgtagaataattacttctgcttcagaaaatatagattacctatcttccagtaagatgctgcaatttatttagataactgcatttattgcattgattttgaaaaattgctcaacctaataccctttcttctttgctaattcctggggaaaaggaatccttttcattttgatccaaatgaccattaatcatattataaagtgtaataattaaccctttttttaagtgtcagagacacatgaatagtgattttatttggtttcaataatcaagtaaattaagtgataaaatggaggccataattaagtgatcttgttttctaataagaccaacccattaatgtgcatgtaaagatgcctgtcatcaatttaacagctttctgagtttaatatacattaagagttttatttttggaacaacttagtaatttttagaaacttgagtacaagtgttggcaaaggttctataaaattctgtctacagaatatgtggaacacaaccttgggtcgtatctccaaggaaaactaccatgattaaaaagacaatgctttgtcaaattcacttgttatcacaatctaattgtgtwaaatgccggccacattytgagtagacactttaacttggcttyccttgggaaataggaaatgaagggcccgaaagaactagaagctgcctctcaattttytttcaacatggcaaaagcatttgcatttatctgtgcccctctcttggctacactctcagctttgatacactacttgagcatgtggaggtttacctactgaatgtgacccttatatgaataatatgagacttttgtatcaacagtagtgatggtttttgtttttaagtcacattttattgtatgtcttctctacctctcactatatgacaagtttagtgaaggcagggtctgtggctatcttgtttattattgttttatatcctgggggtatcacagtgcttgatcatagaaagggctcactaaatatttatggaaggaaagagaggaaagaagggagagtgaaagaaaaaacattcaatgttctcactcttaaaccaagaaaataattgtttactttatttcattgtagtaagaaaactgaacatgctactaccttcaataaatttttaagtctgcaatacagtattgttgaccataggaacaatattgtatagtggatttctagcatttgtctttcttaactgtaattttgtgcccgttgtttagtaactctaaattttcctcttcactcagaccctggcttccccccattccacaatttgattctgtgaatttgaatattttcatagaaaacattttatgagtagaattatgcagtatttgtttttctgtgactaacttatttcacttagcacaatgacctccaggttcatccatgttgttgtatatttcagaatttccttcttttttaaggctcaagagtattcgcgtgtgtgtgtgtgtgtgtgtgtgtgtgtatcacattttctttattcatctgttgatgaacatttagtttttttcacagtcttggctattgtgaatactgctgcaatggacatggatttttaagcgataaagaataaagctcttttcatcttttaactggaattattttttagaaaatattttgttccaattttatgatttttttgctattctttcatgattaaaagttatgtttcattattatcaggttgtatatttacatatatattttgtctgatgttaataatggcatgtttactttctttgtgtaagctgatgtatggaaaatattttcctagcttttatttcacattatttcatcttttgtttcaatcattcatcttgtatattttggcttccttcttcccttttactcaacttagaattttagagtgagtaacttttaagataaaacgagtttaacagataatttagcccattcacatttgttgtaattcatgatatttgtgtgtgtttgttatctcttcatttttgaattattttgctttttaatacatcttttctccatttcttctgcattaccttccttctttattattaattgaggttttttgtgctgttcttcttccatcttttttaaactaatgaattacaaaatttgcttctttttatgatttgtctcatagttattgttaaagttttgagacctgtgagtaaaaatattttatattaatacctagacttataaatcagtactaatatcttgtcttgaacaggacttcatccctagaatactttttatttctacatcatctgcttttaaataatcagatattaaatccagattgccatcgtttcatttttaaactttgcagcagagatttttttagatgtgaacataaggtgtctattttctttgcttcttgttattttgtgttgtctttctctttcttgggtaattttttgttttgttttgttgaatcagtaagcttttcagaaaatgcctgtaggtgttaaatttctgagcagttatatatctgaaaatatctttgctcttacatttggttaatactttggctagatttagaatttaaaattatgaaatgtttttctacagacttgtgaagacattcaatatttgtttcagcacatggccttagaaatgggatatctataccaatctaattcccatgtttctgtaagtaatatacctgtttttatcttctctgagatattttggaatttgctcattattcttggagttttgaaatgtcatcaaaatatgtctaagtgctggtcttgtttagtaatcttgtatacctcaggggaaatttcagtctaaagatgtatatcttttccttcagttttttttttctctctctctctccatatatatatatacacacacacacatatatatacacgtatatatacgtgtaaatatatgtgtgtgtgtgtaaatatatatactttttatgtcttataaaacaaacgttgggatttctgtttctgttctctgtctaaacttttttatgctctccaggccatcatgtgcttgtcctataatctggaccaaacccanggtacacatttgtagctcacaaattcttcactagtcaccatctctgacttatcctaaatgaaatttttttttatttttaaagtgattatattttaaatgtttctttttataaaatgccaaccagtttttcttaatggctgtaatgtattgaatcccttaagctagttcattattcctatttcaagatttttttctactccttctattaattgttttttttttttttttttttgagaactagttttgtgttgtttgcattggagtagcatatacaagccattgtttctgacccgagtgctctcttttagaattttttttttttttagggtcagatcccctcatctagtacctctgcctttaaccgcagtctcatgaatccaactgctattcagcaccttcgactcagatgtctgataggcctgtcaatcttgggagacccctagctgaacttccacagaaggatgggtctgctccttccctagtctccccatatcaggagatgatggtacccttcaccctgtagctcatgccaaccttggattcatcctgatacctttcttgtcctacattctacatccaatgtatgaacttgtgctcacttttatgtccaccttcaaacaaataccatatctgactgtctctcaccactccccagctacatccctaatccaagtcaccatcatctttcacttactctattgcagcagcaatagaccaatctgggctctgcttccattcttttcaccctatgtttattatgtattcagcggcctcagagaaatgtaaaacataaatcaagttccatcactccctgcaaacaacaacaataacaccccttataatggctttaagtcctaagcatgaccaatacagccatatgacatcaaggtcctgcttacttctctgactttctgttctataatttctataatgtctatcattgttcactgtgtttcagtcatattggtcttcttgctattttggggagtatgttcccacctcagggcctttgcacagctgtttcctcacctagtagctctttctctagatattacttggcttcctccctccctttaattgtttctcacacaaaatgcacctcctcagaaaaggattgctctcatccagttatcatccactgtccctctttatcccttttccctgccctttttcttaataacatgtaacgctgcctggtgtgaccaagataggtttgtttgtgtttgttgttgttcttcaaaatagaaacatgaccagggtatgggactgatgacttctccaccagcatatcctctgagggtgctgaatcatttctgttacatagtgggtgcagaggaaatatttgttacatgaggctatatatcaaagggcttcatgaaggttttgctttactgtgaatctggagtcagataattcttttctttatttctcctctgttttctttgtagagatcatgaatatcttaagctttatggtgcctctctctctatagtttggctatgagcctccccgaggcagatggttaactttatttagaaagagggtttcaggactttattctagtgataaataccgtggctgctagtcatagaataaacaagggcatgagagaaggcagccaactagaccagctgttcacaccatggtcctttcataattatcctggttactgcctcttggctgtgtgtattgcttgactccaagtgtggggtgtcttttgtagagctttatctggagctgttttagggagaatcaatctcacttctagtagatttctcctgtgtaagtgtgggctttgatttcctctacttctatttctactaagcccattacttatattaatcccatctactttcaaccttcaaggacttttatttttcaaatttctgatctgatagttaaaattttccccgatgtgccatgcacttattctaaaatatgatttttttcctggtgtcaataagatttggcgtacagggaaagacagatatatatgacttaaattttgtcttctttgcctctattgtatgttactgtttttatcttctgtgttgttgttgttgcttaacaaatgtagctacacatttatatcttatcactgttttcttaaaaataatttgttttgttcttctcccttttatatttagaaaatatataaaaaatgtggaccatgcctttgatcagaaattattatgaaaattgttgtttagaatgggtttgagggtggaaaagtttattaagagattgtaatttaacgaaagagaggtatgaatattctgagaattgaggtgtcttatgcattaattggattgctagatggccccactgatttcctgtttttcttgttgtgttaatctatatattgaattaagcacctcaaactatgagttattagatctcatatatctatatccctacagcaatttctctaagctctggtcatttctgctactttgtaatctaaaactgcttcataacttcctagatagaaatagaatatgtgggtgctcagagtatcagatagaccccatatataatagctatgaaatttcaggctctataatggattataggatatttttgaaccttggtaggttgtaggattagttgcttaaatacatagtaccatagattgcaaatgtttaaaaatcttgatgctggaatttattagaaaaacaggaatgaatacagtttgagaggctagaaccgtggatttcaaatgctagcctgtatgagggtcccttggagggcttcttaaaatacaagttgctggttgtcattttcagggtttctgatttacgaagtataggatgggcctgagaatttgcatttccattaaattcccaggtgatgtggctgctgctcctgggacaacatttagagaaccgctagattagacagtctcacaacagggatttctagggacagcttaatggttactttatgatttgaagctggaatacccaattaggggtttttccagtctcatttcatttcatttcatttgcttccttttttctttcttccttcctccttcccttcctcctccccttcctcctccttccttttttatctcctctccttgcccatcccctttcctcccttcccatcccctcccatctcttccccttccctcccctcccctcgctgctcctctcttctcctctttctttctttgccatttcaggtgctttatctcttaagcactgcactgctttgggttatccatttaagcttagaaggagagcaacagaaaaggaattgaaatgtaaagcagatatcaagagagcaaaatttgtcattaaattggaactagcaattaatttgtctatttattcatagtctaagtgtgattatcaaaaatgcttgagaatcaatagaaccacatgggtttttcaagttggataggaccactgaagctacctggtggaaacacatcattgtattgatgagaagactgaagcaagaatatgaaaagcatctgaaccaatgttttcttttccacgttctcatcactctctgctacccacagctgcccgtcatggatatactatatgttgtcagctatattttgattacttctctgtatatttatcatcatagtttactaaaattgttagtattataccttttgcatataagaaaggatgaacatttctagttcttaaaatgtaagaataagtgattacatattaccttgaaacagtatggaacactttttactttaaaatatttttttcaatttttgtgggtacatagtaggtgtatgtatgtatggggtacatgtgatactttggtgcaggcatgcactacataataatcattttccagaaaattgggtatcagttgcctcaagcatttatcctttcaattaatgctcttagtctgttggtattaaaacaatttttattttctgatgagaaagttgctgtcactttgatcattgactttgctacaggaattttcttttcttttcttttcttttctttttttttttttttttgttttttgagacaggtctccctctgtcttccaggctggagagcagtggcacaatcatggcttactgcaatctcaacctcctgggatcaagtgactcccctgcctcaaccccctgaccctcactatctgggactacaggtgcacaccaccacgcctggctaaattttgtattttttgtcaagacaaggtttgtcatgttgtccaggctggtctcgaactcctcggctcaagtgatccacctgccttggcctcccagagtgcggggattataggtgtgagccatcatgcctggccaggaattttcttgaatgcttcaataactttattccatttaactctcacaacaatcccatcaaatcaagtatcatgattatgcctcatcattcatttcacaaattaataagcaaagtcttagggggttatcacttcccaaattattacatgccagtgaaaaaccaaagtttgagcttgcacacaaactttgaaacactattcaaaagcagtgttttcagcacctgatctttattgcctcacagagttttatacagatacaaaattatgaaatgtagctggagccaggaactatgacatggaatatacctggcatacacatggtctttgtcttttcctacatctgtgaacttgttgaagctttagatgtcttcccagctcagtgatcatgaagacgtcctcactgatgagtcatctttacttgtcatctctagctacctggaataaaacacccagtgtagtgtctgggatccagtgggcatcgtgggtcagttagttctccagccccggttccttttctggttgcctgagcttggaaaattcataaaatctctttggacctcagttacgcaactgtgaaattgtgctatagggtgacttgaaaccactttgtagattttttgggagagctaaattaggtaatgcatgtaaaagcatttagtgcaaggtctggcacataggatatatttgctaaatattcgtagaatcagatgaataactctcatgaaatattttgttaaacattgtgattgttcactgggaatattatatggctgtgtgtgccactgtccgtgtttcccctaataattaataaatattaaataatttaaaattaaatattaaataatttaaaattaaatattaaataattaataataaatattaataaatacctttggcaagtatatactatgtcttcaaaatgtttcttttccatttaatgttttcatttatctgcaacatttcttaaggcttatttgcatgtgggtaaaattcaggctacaataatagtcaaggaagtatatttctcttgttctgctcccatacaaatggtgcccccctgcaagcctcttctgaattattcctggacacccaaataaaaatggtaatttttctttccttttctcctggattcttattctaacatctgctaggaggatccacaccctgtcctaggctagtagtgtacagaccatggttttgatgtctgtgcaaaaggtacaggtttgtttgcatctcttcaatttttttcattgtatgaaaatataaataatataaaatgtactatttttaagtatacgattcactggtattaaatgcatctataatgttgtggaactatcaccagaatccattgccatagctcctttaatcttacaaaactgaaaagttgaactctttacccattaagcaataactccccattccccctcacttaagccccgggcaccactattctactgtctgtttttatgattttggctattcaaagtacttcatataagcggtatcatgcagtggtatctcatctttttgagactggcttatttcacttagcataatatcctcaaggttcatccatgttatagcatatttcagggtatttttcctttttaagactgaataatcatccatttatagatataccacattttgcttatccattcatccagccacgggtacttgggttgcttccactttttatctatcatgaataatgctataaacatgaatgtacagatatctctttgagtccctgctttcggttcttatgggtatataccccgaagtagattgctgcatcatataataattctgtgtttaaatttttgaggaatcaccatactgttttccacagcatctgtaccattttgcattcccaccaacaatatacaaatgttccaattcttcgcattctcgccaaaatttgttacatgttgttgcaaaagtaattgtggtttttgccattaaaagtagttacttttgcaccagcctagtatttttttttctgagtttttttttcttttgttagtaatgggtgtgagtggtatctcataatttttatttgtatttctatagttgttattgatgttaagcatcttttcatgtgcttaccagtcatttctgtatctcctttggagaagtatctgtgtattcagcgtttgcttattttcacattgaattatcagtattttttgttgttgaattttaggagttctctatatattctggatattaatttattgtcaggtacagatttggctttgatggcactaaagctacttcttcttaccttcgaagtcacagtacctgtaatgattgcttatgtttagcaaattaacatcattaggctttctctgtcattatataaccccttcatcctaagactcacacatgagcacctcaactgaggctggggatgtgtgtccctgttgttgggggaacacatgtccttagctctgactccctttctccagggtcatttctatcctctcttccgatgacggtctaccccacagatcctaagccacatccaagtcacctgaattccagcatgattcttacttagattcttaagtttaaatgcttgtaattccttcttcctttcctctccttattaagtacctttaaggaagtagaaaactctcaacatttagaaacacttacaagcatatgaatttccatattattaatgcctcgtgaccaagatgtcctgacacatttatatggtcctgtaaaagttttataaataatctggagcatattatttctttatatcctcactttgtgaactagacaaggtagatattaaaattccaagtctcaggaagtttgaatgatttttcttaagcttagtcagctaattaggagcagaatcaggactggaatttagggcttctggctccactttatctctgaggcttgtactattctactgggatatcattagaagaaatgccaaatgaatgccattgcctcttcagccctaaacacaaagcccagttaagtgtttccctgacatttttcctgacatctataaaaattcatattttatttttattcacatgctgattgatttagatgttatgaaaattaaataagttccaaaaggcagaagataggctatacacatatttttaaaaatttgtcattgttcaaacaatattgaatataaaattgaaatgtccctcattataaaaaaaaattctctaagagtgactagttataaggttatatcttttggcatgatgcacctctaagcagtgcttgcataaagtctctaccaaagctgacagagcttccctaagggcctaaagaacttggcaaatgttgttgaacaaaaatgacaacaatgaaactgtgtaggaggattctgcattagtgcacctaagaatgttctcgctaatttgagcacttctcaccatggaataatgcttttgttcctctctgtctttttctgctgtctcacagagactcctaacagggctccctggaccaggcttagacatcaatagggatggactagaggcattccatggaggtgacaattacagaagatcagaagtgcctagctacacactctattttcttctagcatctgaaattattgacttgaacccatttgtggggtcactaagccaccttcatataatatttattacatgtgcaaagtcagaacatatggagagcatttgcatttgaatgggggaaacatgctgttagataaattagaaaatctttatatttgcatttttctttatttaaaaaaatcaatctgtggtatagtagagctaggaatattccctttttggttgacttcttcactctgtgtttaaactttctcagcattgaggcatgtgattaaaaggagctattttcctaatacaaacaaaagcattgaacatcctgtgaaacaaaagttgttcattttaacttgcgttatatggaaatgtgacatgttttagatttgtgtaagctcatgtacttgaaaatcagacttgtctaaaatttcttttgtaagatattagagaacttttgaattatacctcttatttttgaatgtacattcctcagagaatcatctttatgcacaaataatgtttattttatatttttaatctactttagcagacccacstgattcttctacatgtaaggttgaaacagttttgagtgataaagaactgattttatggagcaactaatgattttgctgttgctacttttgtgccagcaaatacgtaatccacaagaatgttataagaaagatatttatcaagcctctaaaaaaraagaaagtaatcaaaagataaggatgcataaatatcttaagactactcatgacatcaaggaaggtgaatcagtattaataattcactagtttgtgcatacttattgtcaggtgctgggtcaaattaaattggaatgatttgttgacatgaggatttctgggttcatgatggattcacattaaaacaatttttatgttttaagccttctcccatcaaataggttttacggtcttgtgtacacattacatgagggaaatagtactttaacattttacatgctggtgtatagtctatatcagcagtccccaacctttttggcwccaggaaccagtatcatggaaggtaattttgccatggagtggggttggggaaaggagatggtttagggatgaaaccgttccacctcagatatcaggcattacattctcataagaagcatgcaacctagatccctcaaatgtgcagttcacaatagggttcgtgctcctatgagaatctaatgctgccactgatttaacaggctgcggagctcaggaggtaatactcgctcacctgctgctcacctcctgctgtgtggcccggtccctaacaagaccattcaccggtaccagtcagtaagctgggagttggggacccgtgttccacatgttataaaaacttaggctgggcgcggtggctcacgcctgtaatcccagcactttgggaggtcgaggggggcagatcacgaggtcaggatatcgagaccatcctggctaacacggtgaaaccctgtctctactaaaaatacaaaaaaatagccgggcgtggtgggcgcctgtagtcccagctactcgggaggctgaggcgagagaatcacttgaactcgggaggcggaggttgcagtgagccgagatcgcgccactgcactccagcccgggcgacagagtgagacttcttctcaaaaacaaaacaaaacaaaaacttaaagagttatttgagccggacacagttgcatagacctgtagtccccagctacttggtgggctgaggcaggaggattgtttgagtccaggagttcgaggttgcagcgagctatgattgtgctacttacactccagcctgggtgacagagcaagtccctgcctctaaaaataaaataaattcggaaagaattatttggtgattcaagtataaaacaaaatctatcagatatttgtgaaaaacatattgttacattgttacatgttttaagaagggaattaaactcctagactctgtatggtataggagttcaacactataggttggtctatacatctaatgttggatatgtattttgtgccttttatttaaaataacatacattttatggcatttcttgctttgcattaattactggccatacccagaatcctttccttcgaataaaataacctcttttcccaaacttttacatattgttcatattttcaaccccctacacagttgttaggtcttgaatttggaagaattaaagggaataacattaatgacagtgaactatgaattaggaacctcacccctatcaatagccaatttccctccttttcagttttgtgtctcagtaatagtccttaaaacaacaaatgatacattaagtgacctgagccaatttcctcttgacatggaactattcaacaaagcctcacataagctaacatttcctaattagccccttaactgttgacttgagaaagggtttgcaatacaggattcttatatattaataaaaactataggtaaaaaattcaagatgttgttgaatctttacagttcgactcattattcaaattcttcatctttacatcaagtttctcatctttacattcctctaattcaggtcatctccacaatatgtccaataaaccgtatttgcaagatatcgggagaaaagcgagtctgcctctaggaattataactgatacttcctttgtgtgatgaacagtgattttttatgtatttagtcatatgctattagggaatagatatctctagatcagagaacagattgtgtattagtcacagaacatcttagcactagttcctccagccctagttcctgtggagtaacgcgatgagggccagatatctatccccatgggcagcagtgttgcaccgcatgagaggaaccctggaattatgaaacttggagcttacacagggcagctgggcacatctgcccttcctcccctccagagatagaaagacttgtatgtattctggcatgtaagcaaatgactctcggggagagtaaaaagatgcctccaggttttatttcatgagcatatggctccagaggagacgcatctctaaacctctcaggaacagttcattgtcttttacttctgagacatactgtccattcagtcattctttagccaaggttgccagtactctttgctaagaaaccccagatcatgcagaaatgtgaacatgttcacagagaattgtctctcaatcaatagtacctagtacattattatacaaagttctggggatgtttggcagggattgaacccatgaactagaattatgagcattggaacttatctaaaccaattagcaaataaaaaagttacacatttcttgagaaaataattttatagattaataattacatgtaggatatgcatatctcaagtcatctgagggtttaatgttttgtatactttatcttacaaaatagattccaattcatgctgtctggatatacaagcattaaggccttccaaaggcaaaatcaggctaggtgtgaaacatgagtggtatacggaggtatagcaagtagtgtcccttgatacccttggggaattggttccaggatgtcccagagataccaaaatccatggatgctctagtctctgatataaaatggcatagtatttgcatgtaatctagcccactttcctgtatactttatatcatctctatattagatataatgcataatacaatgtaactgctatgtaaatagttgttttatttgcattgtttagggaatatgacaagaaaaaagtttgtacatgttcaatacagatgcaatgttttggaatgttttggggcatatttttgaatccacagatgcaaaacccatacatataaagggctgactgtatttaagttcctcattctggtgtgattaattttatctctttttagtatacttgtggttctcaagtcactaatgttttagttataaggtgaaaggcacactgtgtaattgaatgctaaggccaattctttacctctgatgtctggaataagagccagatttcccatccttttatggaactacaagcgtcatggctattagcaatcccagaatagttctactcccactttggctgagtttaagatctttttctaaagacagtaaaaagagcatcagaaaagcatttgtgaggctgaagtacctcacataccaattttgtgggcacatttttggacccttaagttctttttgacagttttataaactcatgcccagagtagtttcctttatttaatatttgtcttaccctctacttacaggaaatgcaaggctcatcagctttttcagggagtagcatgactcagagtctgatgtacttgaaaaaaacacagcgggaatccaaacacacttatgtcatttttatgtgttagagagaaaccaggaagcatgaattctcacttttcttaacgtctttacagtgtcaaagggatatttgtgaaaagaggttgtgggaatcattgttctgaagtgcatccaagattagaagcctggtttatgtgtgctattttgcctcccagtatgagcagcctttttatatttattccaagtattactgtaaactactttttctttatacatacacaatatatctttgtctgtgatcagagcggagcttcatttccactgaccaatagaagggcatttttatttgatttaagtgaaacttggggcataatgcattctttcaaacctctgattggacatgacaaacaaaaagcttgagctagaccatggtcatctgaactatttccaataacttacctttgtaattggagtattgcctcaaatatttccctgaactctaattaccatggatacgatatcactcaacagaactttttcttaggagcactaagagtgtggaagacagaggataaatgttgtagtttcatttgattatctctatgtggatgctcacatttttttttctataaccaaccagtttcattttgatgagagtgtttggagagatggttatgctgacactagcctaggtaagagagtaagtctccctctcttaaaaaaaagtgacaatgtcacttctgctcacagtctgttgatcaaaatgaggcaaacggccaaacctgatgcctataggttgaggaaattgtgtatttgtgaatagtaatagcacagcagccactaggcctcccagtcgtactggagatttctaaaaggcaaagtgtttttagtttgttttaggtaataggttgatatttagcctattaaaaaggcagaccctggcttgacagacaaaaattaataattaatttgggagccagatacagacttaggttttttgaattcttgtttctatattcttattttggaagtttacagtttggttttatatgcaggggtgttagatgaaggtgtattgttttgcaaatagaaacagtctcaggagacaaataacaatggcatgagaaatttatgaagtttatttttagcagcactttcaggcaaggttttgccatcaatattttcattggtacccaagaagccaacagaggaggccatgttttatgaattgatgtggctacaaatattagctctgacattttttaagtgaaaaatggcagaaaagatacagaagcaaataaatatagagtctctgacagccagcagagatggaaccctttctaacaattatgaccaaaggtatgtgtgtgtgtggtagtttggtttatacttgcttgaatgctgtccttgttctttttttttttttttttttttttggtagttcttgcaccaagtgactgacggcttcctccaaaacaatgtcagcaggacaaggatgtattggcagggtatcttttgaatcagtaaccccatactgatccttgacctaattaacagtctgctataggcatcttgcagtttactgctactgctatcgcaacatcaagaaaatgttgaaacttaagcacccataagaaacttaagggggtgtcccactcaagtcattataaattcagttttattatgctaaaattgtgtgaactatagttcacacaattcaggctggctggaagcctgaatactacattgttttatattataccacatttattggaagagttggtttgcttttaaaggaatccatcactattagtttcatggcgtatttaacatctggtcaggtcagttcaatacttggaaatgttttgatacttgaagtttccagcagattttaacacatgcctttggatgtaagtaaacacctttgtccacaataaataaaatgtaactgagcaaatgaaactgtcacaatgctttgaaaactgtagcatactgaccaaatctatgccatgattttaccttctactgatggaaagaaaagtaactttgattattgcaatctgggcaattcacttatgttatcttatttaactttcatgaaaatcttcatatagtagctatcattattccatttcaaaatgggaacagaagcttaaaaatggaataatttaaagacatacaacctagaagaggcaaagcttctgaatacaacagctatctaactccaaaggtcttggttcttataagaatccattctgttttatgtctgtgattgtaagcttttagcagtttctcttcttctatttctttttttttatattttttattatactttaagttttagggtacatgtgcacaacgtgcaggtttgttacatatgtatacatgtgccatgttggtgtgctgcacccattaactcgtcatttacattaggtatatctcctaatgctatccttcccccctcccccctcccccctccccccaccccacaacaggccctggtgtgtgatgttccccttcctgtgtccaagtgttctcactgttcaattcccacctgtgagtgagaacatgcagtgtttggttttttgtccttgcgatagtttgctgagaatgatggtttccagcttcatccatgtccctacaaaggacatgaactcatcattttttatggctgcataggcctagaaaggtgcagaaactgctttcaattcctgaagggacttgtcaggcaaaataaacatactgaaaatagctttgaccatttctaaatcctttcctggatcagagttggaggttgctcctacattcatacgcattgctgatggattctcatcaatggcccctacttctgggttggctgagatcaataaatcttagcagtttataaatggaagaaatggctttacatatcttgtttcctgaatccctttggatattttaaaagaggtgattaaagtaaatttatgtttctgcagatgcatgtaaagctaattgttttaataacagtataattggcgaaaggaagttatgtgtaataagaaacaaagcgtaccacttccaaaatattcacattagrcatttgttaaatttgcagtgagtttcagcatacacacatacacaacacagaccatatgtgaacattaggaagattgatttgtttaaaaaatccacttctacaccacataagtaatatttcttactgagagtcactgaagtgaggaagaaaaataaccacataaygggaaaagaaaaacattaaatttagttatattgtatatgttttgtgtttattagtttttattaattgtaggcatgcaggtaaaaaaatcgcctcatttgaaaattaataacccagggcacaaactattaattaaggcatatagcaaatgccttttaaaagtattttatactggctgggcatggtggctccgcctgtaatcccagcactttagaaggccgaggcaggcaatcatgaggtcaagagatggagaccatcctggctaacatggtgaaaccccttctctactaaaaatacaaaaactagccgggtgtggtggcgggcacctgtagtcccagctactcgggaggctgaggcaggagaatggcatgaacccgggaggcgcagcttgcagtgagcggagatcgcaccactgcactccatcctgggtgacagagggagactccatctcaaaaaaaaaaaaaagtattttatacttaagtttttctagctgctagtttaagagagatgagaatacattcaaagagcagggaaaggagagtgtctgaacagaggaatttctaaaaatgagtacagtattaacacagttatccttacaatagcctgaggtcaggactattgttttctccacattttggatgaagggactgagacacagagaagttaagtaacttgtataagatagagaagagacagacatgaaactgttataaaaaggaaagagacaggaaaagaggagaggagagagaaagaacaaagcttggatggcaagttaacttaggtcatctacctttgaaattcaagtagtctgtaacttttgccattacatttagaggcaccctctgtgacacggtcatagaatactggttcactcttaggcattcaacaaatgcctattgagtgtcagtcatttattcaacaaacatttactgaatgtctaattaagtagcagatatagtgctagttacttgagctacattgcggagacagggcctctttgaagagcttgtgcttcctctccatgaatgctagattcatgctttccacctaaaccctacttttggaaatcaagaaaagttcacctccttcatgagacttcttggattaaccccatagtctattttcacctagaaatagaaccctgtttttgagtcatgcacgttgccagctgggataaaaggctacatttcctagtcttatacctaggtgaacccatgggtctcaggtcaatgggatgtaaataggatttgtatgagaattctgggacatcctccaagagagcagattcagctggcaggaaaggaatttgctttctgatatggtttggctgtgtccccacccaaatctctacttgaactgtagctcccgtaattgcaggagggacctggcaggaggtaattgaatcatgggggtgggtctttcctgtgctgttctcgtgatagtaaataagtctcaaaagatctgatggttttgcaaaggggagttcccctacacatgctccctctttcctgtcgccatgtaagacatgcctttgctcctccttcgtcttccgccataattgtgaggcctccccagccatgtggaattgtgagtccattaatactcttttctttataaattaccaagtcttgggtatgtcttaattagcagcatgagaatggactaatacactttactacctatcctcctcctggcctggaataacatcactgggtgggtggagtttcagtcactgtcccaggacaggaggtggcctggagaatggaggccagtgcttaggtgtggagtagaagaatataaggggcttgcatccctgatgacctgaaggtcccatttcagccctcaaatagcctctttctggatttatttcatttgagagagaagcagttacatgaagtttgttactttgtttgagagataaatgcagttatattaggtttgttaattttgttttgtttttgttttagttgtatgatgctaaatccaattctaattgatatacctccttcataagataattttataaacccctggaaggaagattgttcattgggctttggcaggcagtgaccttaaaactaggaaaaactgagctttaagggcccatgaaagtccttggcttgtgggtttgctggctctttgctagaattatattttgtttttttctggttcagggtaccgtaacagaaggtgggaagctatatttttcatgaaactgattgcttttctaattaacaatcttgctaataaagcaccactgtacagcagatatagtgtttttaatgtcatggatattgtacctgaaagtaagtgaagaagtgtcagatagtttctgccaatatttgagcagtcttagttctaactgctacaattatgcaaggtatttgtcttagaagagcaatggccatttgagtaagactttccatatggtgttccacagtcactgggagaaaatgggcctttttttttccttagtgaggtgatcctctccttctttctctacaaagtaatgtggagtttggaatgaattctaatgagtgaataataggaagattttgcatactcatttggacaagataaacacaacagcatggttaaaattcttgagatgaaaggctgagtttctgtagcttgaattttagatgataaatatcaagaatctatttgaaggtcagctatcacaaatataatttttctctggcaacacttgggtagctttccttggcaaattttactcaaaaagaagataaattatttctgcctcaactttttcttttacctctcttcttctttctctttattcgattgtttgcctttgaaagtctggctttcattgcatcattagacagaattgtgtgaccattcccaaagagattgacagtgttcatggcaggctgtataggaatctttctgtgtgcaggctggtctacaatttagcataataaagatctggccttatattcataggatctagccaggaaaattagtcttacctcagggtttaaagaaatgagggtgtgtcccagagggatctgtctgtggccagcaggaaatttaattttaaaaactgaagaatatacaatagttcaggcactgaataatttgagcctgcgaaggtgcttctgccacatatattatcatagtgttagtaaggccaggaaggtctgaagtttgtatgagttcacagatattttgaaagactcatgcaggtatttttgatatgattccattttaaaatcacattgtctgtgatgtgtatttatggcattatctaccacatgtgtttgtcctgtagaatttacattacaaaaccttctctgatcaataattgacgatgagtgactgtagtagtttgggaaataacttgctttttactcttttgtcacctgcttcaatatagttcctgctgtttgatgagaattgactgagctggagcctgcaaaagtaactgtagtcaaattagttacattaaagggtcaaaattatagctgcgtggagctaaggtcatggcagaaccaaagagctctgggcacagatcttcctttcatgctcgactgggtccaataatcccccgaggctcaggtctctgattgcatttccagatggtctcctctggtgtaaacaccacccgcgctctgtccaacagcataagctaccctggcagaaagcaaaacagcaggtcagggagccctgggaattacacagtgggtggcacctgttgccaaattttgacctctctcatcccctacgttatatacccatgatattttcaacttacccctttcctttggtatttgcagggcaaactctctagtttcttagaataaagccagcttcatccactccccttcctaatctccatatattcttcaaactggtgcttagatttcctggctatcttgcagatgaattctaatatctactagtcagtagaatgcatttgtgtacttacacacttattattcaacaaatgcctattgagtgtcagtcatttattcaacaaacatttgctgaatgtctaattaagtagcagatacagtgctagttacttgagctacaatgcggagacagggcctctttgaagagcttgtgtttcctctccatgaatgctagtctcatgctttccacgtaaaccctgcttttgggaatcaagaaaagttcacctccttcatgagacttcttggattaacctctctcagatctgagcaggttgtccttctagaattgtcttaatgcatacatttgcagtcccttgtaaccttgttagactgcttctttcatgtagatgttttaaatttttcatagtgtgttgtgtacttgttcaaacgcaaactccccaagagagattcacttctggcaccttcatttttgcttttcatttcccctaatacattgctggacacttaattggtgttcaataaacatggtgaattcatttaacaaaagttattttgcacctaccatgctcacggctacaaatggacagcattatcacagcaactggacattacatagcatgcggaatggcagatggacagaccatatctataatatacttgggtaaaattttgaatgtttattagaatttcatccactgtctcatgtcttatagctacaagttaatttccaaatttgaatatgtccatacttgtttattaaaaagctggggacgatactctgtgagggtttctaaggagcatttgataaggtgtaaaaccactatagtcttggattcttctcattgctgagcagaatgggatgtgtcctgcagcaggttgagtggctctatgtggttttatgaccatacgtaggaacctgcttcttctcttgaaatggctgttttgttttatggagattggctagactggcaggtgacaaggcaagaggtgggctggccacgagagccagctgagcagtgcgagttggtgtgattcagccatttgtcaccaccatattctgccatagatagatattttctattcgagaaagtggatcaamtttcactgtacaccactttctcactakgstagaaatacatgaatggtggggcatagttcactccaaatmtgatccatctaaacttttctttctggtgagttgatctgttttgagattttacactttacataaaaatagtatagcagccactctttgccagtcacaaaccacctttagctgagagtattatcatatcaattgtttcaaggaaatgacaaatgagtagttaccaaaaaaagaatgaatgaatgaataaataaataaacacaagggaatgagttgttactagacagagaagaaaaagattgcttggcatgtcccaatttggttattgaaaatttttatttttgatgcagtgctcttcttttttccttccttccttccttccttccttccttccttccttccttccttccttccttccttccctccttccctccttccctccttccctccttctttccttctgtaacttaacacctatttgattttttgaaaacattttttattagatgcttagatcagctgggacaacttaaattgcaagctaccagaaatatcatattaaactaaccagtgaagatgacagtttggatcatggaggtagggttgatttcagctgaggtttgctttagcagttgcaacactgtgatcaagatctgccttctctccctccatttcaatctagtttcctggccttggctctattctcagcaggtcttgtcttcctgttcctaaattggccatgagcatctcattccttattctaatccaacagggattatacctgttggtatacctactcctcctacttcctcccttagtctgtgggggaaaaaaaaaagaaagaaaagaaaagaacttctgagcttcaatgtgattaggtcatatgcctatcactgaactgatccctgtggatagtgatgggattttgctgataagtctcagtctcagcccccttccccaataccaccatccactttaaaggttttggtttaaataaatttcccttgaaaaattttttgggggggattggatgcctaaatgacaaatttggtgtcctttcccaggaaaagggaaattttttccaggccgtcaaaaactaattaaatgtcctctctaaggtttcattactaagatagcacacagtttgctgctgctcctcctctttcttcttttttttttttgagacagagtctcactctatcacccaggctggagtgcagtggcatgatcttggcttactgcaacatccgcctcctgagttcaagtgattctcctgcctcaccctcctgagcagctggtattacaggcacacaccaccatgcccggctaattttttttgtttttagtaaagagggggtttcaccatgttggccaggctggtcttcaacttttggcctcaagtgatctgcccccgttggcctcccaaagtgctgggattacaaatgtgagccaccgtgcccagcccacattcttcttaaagggtttgagattttttttggaaattacagggcatatagctttgtgctttattcaaaatgtcatagagcttcaaacagttcttcctgagacagatgtaaaacaattttaagatttctgagaagtaatttatatatccttataatagtcataccatgtgaaacctggcctgctaataataagaagaaacatctggaactagtgacagggtcaattttgggtattctctctctatggagaggactagttcttctgagattgatgttggcagtttggaatcttttcccagtgggaaggaagacttagaagaggatagttgatattgcctctcctcccacaagcaagtttcatctttatcacagttccctatggctatgccattttgagatttgtatacaaaccctgtacattagtgagggactcactcagagaccacctagactccaatcagtatccagcctttaggagatggcttgacctgggcagcttccccagtgatggagtttacaaaggatgacaatgaccatattttaaatctgttgttactctcttgcaagactcctctttttctcttgcttgctcttcaccttagcacgtctgtacacacctgcctttggtataacttgaaagacagccctaattgaggcattcatctcatacaatccaagagtcaggaacacagcttttgtaaggaatgcattgtggattcttcagatgtgatttaatgaatatccaactgtacttggggactaaaaagagcatttttaaatgagattttgctctgaattggaaagtaagttgaggtgggaaataagccagccattaaatgctctagttttttttttttttttttcttgagatggggtctcagtctcactctgttgcccaggctggagtgcagcagcatgatcatggctcactgcaacctccaactccccatgctcaggtgatcctcccacgtcagcctcccgagtagctggaactacaggcatgtgccactatgcccagtaaatttttcataatttgtagagacagagtttcgccatgttgtccaggctggtctcaaactcctggactcaagcagtctgcccaccaaagcctcccaaagtgctgggattacaggcatgagccatcgtgcccaaccatagattttttttttcataatggcagagaatggctgcaatttagggtctttcttargttcttcctcatccatttcttgcagaaaatttagtactttgtatttctttcaataatttcaacaattttatcctgacttttcccagagcaaaaattaggatggggatgttagagcttcctttgagcaggctatcatcgcaatgaaatcttgaccttgccccttgtagttgcctattgctttataaaacttgttattgaaattgcaaacagtccaaattatatagtagtttctaatgtactttatcagggtgtcagtttttcttttgcaagtgttttgaggagatcagattgttaatgaacattctttgagaatctgaacctgagaactgtctctttaggatgaagttaccaaggacagatgcaaaatttgcaaagatacggtgttccagcctcctccaacaaaggttaacaaccacccgagaaccccagtgccacttacctaccacctcttacctttggaagcagattgcccagtgacggataagtgtggaaactgttcaaagattgggaaagaaaattgttagaaaaggcacatagagaagagtgggattgggggcaaaaggagaaggaggatagtcttctgtgtttttttgattggttaacttaaaatctcagctatttgtttacacaaaggctatgttgatgtccatattcaacagatacaggtatttggctcagaaaagcacatggttcccagaccatttgccaaatgtcctatccttgttcagctttggttattatgaatatccttctggaagcaactgacacctaacatgtctgaatcctctggacctgtagagttcttaccccggagtgattacaatttctgaaaagaacatccctgcaaaattagctttcaaaatacgtgcagataagcccatagaactgggaattcctccagggaattatatcctaagtagcctactacaatgcttgattccttgggcaccagtggttgctcaataggttttttaataataaaaactagaaggaaagaactattgttagctaaagttaccatgtaataattggcttgggtatgtccctgcttgtttgaattgcttaatgtctgttctttgcacagcagaaactcttgtgccacttcctgattagtcatcttggtcttctgtttcctgagctgtgctccatgatctcgtgtaaatatatacaatttgtgataaaatcatcttgctcattccatagcaggtataagtgggttaattctattgggaaacaagctcaaattttaacagaagtttttctttgcttcaagggaacgagtttcccaacagtgggaattttaagcattttggcaaatcaataggggagatattttcaaaccagcatgattctatttggctcaggtaaaagtaagcccttctggactggcttgcaggtgggttcttgagtcttggcttatttaaaaagctgctgcctgttcttaataaatgccatgatatgaggcaccatgaacaagctggatttaaacctgccctatcaataattttactcataagttcttggcaagtatgtttgttgtctgctgtctgcctgtcaaggttgtcagttagctaagcatcagccaaccacatgatgctgagtccccatgattaatctgacttggtaatactgttcatctatgtaaagaattggaaaaagtagatctcccttcatggcgttgtgcgcgcacgcgcgcacacacacacacacacacacacacgcacaccaatttgtttaaaataaaaaaagattagacgaaagcataaaatcagccctctggtctgaagcaattaatctgtagaagatgctacatatgctgggtgtagtggctaatgcctgtaatctcagcagtttgggaagctgaggtggcaggatcacttgagctcaggagttcaagaccagcctgggcatcaacacaagaccttgtctctactaaaataattttctaagaatagctggatatggtggtgtatgcctgcagtccctgctgctctggaggctgaggtgagaggattgcttgagcccaggagactgaagcttcagtaggctatgatcacatcactacactccagtctgtgtaacaraatgagatcctgtctcaaaaaatttaaaaaataaaatgaaaaagaagatgctacgtacattatacacatataaattagtaaccaaatggtttaacaacctcagtgattgtgttgttctgtagtttgatgacttttatcttgctccttctcattgccattgattgtaccaggttatttcctggagcatgttgtatatcaaggtttatgcaactgtacatttaacctttcagtgcctagctttccccttttcctatagaatcacaagaatttgaaggcaacacaatatgttttctatcttatagtctgaagttaatgcatattaatggcatgctgctattactagttaatactgatgccatgaggattagataatcattgtaaaaaatgtttaatagagcattttttacaatacttagtggatgccagtatactaaatcctttatatatgcttaggtcttttatttcccacaaatctgtgaactaggaattatgaacgcattttacaaaacaggactcgttgcataacttgccaagtcacacagctaatgaacaggagagtcagaacttgaactcagggttgcctgcctctaaagtcctccactaattctcattcattctgtaaaaatagaacatggcctctagaatctcgtcatttagaaaagaacagccttttggagattggttagctggtttgagaacatgtagtttgtttatctgtgtctttgactagtaataacgttcagcctcattaaatctagtaagctaaaaggaagcaggaaatggctgtagtatagacgcttgatatttcagcgatgataatgatggataataatgtgatttcacagcttgggttatcagacccaggtgagtggataagtggattcagattcattaaaatcaccgggcctagtttgtggccttcctttcacaaaccccttaggctgcatattaccctttaatagcatatttttcccattatagttgcccttgctattcatttcaaccacattacaagtataaacatgtacaagggagaggacagatgtccttcccttctgtattaactctcttgttgtatgaaataatgttatgtattaaattattgtctcagtttatagagtctgctagactgtgctgttcagtagaactttttgggatgatggaaatgttcaatgtctgtactgttcactaaggtagcaactagttacctgtgttagttgagcgagcacttgagatatggatgatgaaactaaagaacagatgtttaagtttatttaacccatctaaatttaaatgtaaatacccacatggctggtggctaccttattggacagcagagatttagaatagtaaagctgaatggaccttagagtacatgtaaggcaacacattctttttattttagaggaatgtaggactcagagcatgaaaaggagtaaaaccaagcctaggatcctggtctcttgacttctagttcataatttcttccactaaacttaaaattgttaaaaatgttactttgaactttagtatttgaagattatcgtggtaagactttgcttatatttacaaaagcattgtaacagaaaataaattttgaattacaactgtgactttatcatatttattttacattttatgattgctaaataggtcatatattgacgtctttacatatttgttgggagcaaaagagttgaaagtaaagttttcttcccatctatgttatttagccattgattcccctctccaaagggatcagtaatagtttctttgtgtatctttttaaacattcagatatattaagtatttaaaactgtgtattgttctctcatctttttaaacaactggtaggatatgtacactacacattcatatttttgcattaaacttatatgtggagatcttttgatgtgagtacacaaaaagggtactttaaaacagatacataagcttctattgcacgtaccaactgtagtttaatgcatccctatcgatgaatatttacttcctttccaaagttttctcttaaaagtaatgctgtagagaataactttggacacataactttcatgtgtgcaaatacattataagataattcctagaaatgaatgcactaggtcaaatagtatatacacattttaaattttgataaatattataaattgctctccatagagtcacagcattttatattctcactgacaatctgtaatctctatgccttcatcaacctagtgtgttaccaaactgatcaattcataccattctgacaggtggaataaaatctcagtgtagtttaaatgtacatttttaaaaattgtgaatgagctgggcatcttacatatatgtaagggccatttgtattttatttattgtgaaatatgtttgtatgctttgtccatttccatcagtttttaaaattgacttagaggagcttttatatataagacaaaatatgacatatatggtaaacaaaatgcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaatratcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcrtgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagcttattcctacattgttcttttttatgtcttcaaaatgggccttttgcatgtatgcatcaaagctattgacttgtattgattaacttgggcctcttctaaattttttcactttagaaaaaaaatattttagcaattggttattttatgttttccaaagacctaaatataaatgtacaggtgatgaactgcactttttcctttgaaatttgtatgcctttactttctttctctgatataattgtattcactatttcctccagaactagttaaactagagtagaaatttttggcatttttttggttcctaatcaaagttggaaaaacagacttttcccttgaaatgtagtgctggcatttaggttgagatagaaatatttcattatatgtttttaatcaagaatggatttgaatttcatcaaatactgtttaaacatctatgataataatttgaggtctccataggtttattaatatcataaatgaactattttagccttataactttaaaagccttattcttttaaagttttattcattctcctcccattcttgttcactattcgttgcccattcttgttctatataaaaaccccagtggtccctgctgtgaattcaatgacatcttatttcttttccttaagtcagagcaaatgtgcacatcagaagagcaaagtgtcaagtaatgatagctggaaattgagccacaaataaacagaaaatattttcttcattgttatttgtgtgtatgcttgtgcttctttttttcaagggagtagaccactgttccacatgttccacagttgttttatggtggaatgctctagttatggaaaaggagaatggagtctagccgtataaagttactaaacctgcttggatatgagtcaagggtatcctttttgtgcccaaactagaaaacctttccccttctcatatttttgagcaaggtgttttatgttgcaaagtagcccactgtctcttttcaactgcataagcccaaataacattttatattccagtcagtcacaaaatgaaaacaggaaacgtctttgaagcaaggcaaaaatgtcagagtgtctaaaacatagaagtacttggtgaaacactttcagcgtcttagctctgcctctggctagtcatttccactcgctgggctcagtcaggtctttcattagtgaaacagaggtggctgagcacttcctgtgaaatcgcagggacaggattgtggccctctggagagggggccaggaggaaaaggaaccagacagctggttttcgggagccaccagatgggagcaaatttccaaggctgctgagaagaatggtctagaataacagaattgttttgtgaaggagccttcctaaaccaaatgttctgagcgtccccgcaagcagagcaaatgagcacatactgtgttcatggggaaaaggacaaatgactgtacaaatggagtaacaaacaatttacgaaaatgtatgtggcctaaatttagtatcaaggtgatgggcaaaatgacttacaccaatttgtgacggtcctgttgcaaattcaatgacaaagccagccagtctacctagtccatagtatccagcagatatatcagtggagatggcccgagtgcaggctgcttaaataagataaatcatctgtgaagaaggaaaaggtcaaatgtgctattctctgtctttttttttttttttttggtctgaattaaatggaaaccattacaatttcttccaagaaaataaaaatcagcacctacaataatgctgtctccttctgaccctgccaagtctgactgcattccacctggaccctgcctttgtctctcatgtttttatccaagaataagtaggctaccttgtagtaaacaggaaatcttactcttacctcgcactagttagttatgcgtggtacttgatccataatcttctgcccccatgtcatagaagataggtttttccaactctcagatggaaaatcactagtgcactacacacacacgcactcatgctcagaaatattttcacagatccatttttctctgtgtgacggaggttacataattatatcagtggatgtcctgcagtccagctggtatatgtagagcaactgcatgtttgtatcactctgttaggtgcagtgtaggacacaaataaagagagagaagggagagaacactgccgagtcattaggggcatgctttcagttcctatacagccaagtttttttttaggcttggcctatgcttttttcttagtttgggtttagtatgtattcattcattcatattgccatgtgtgttcaacaaatattttgggatgcctgctctgtgccagacattgtgctaggttagagggatgcaaagacaaattagaactccttttctcaaggagacttctggttattgtatttgtgataaagttttaaagttactatactttgcctgcctagaatgtagttggatctcaaaagaattactgagggttggaggtttgagtggcagaagagcaatgattgatgaaacagagttttgaaagatgagtggcctatttgtcatggaggtaggaatggggggtgggtgggcttctggagagacacagcagaagtgtagagaagaccatggtacttgtagggaacttctgtggtttagagtgagatggatcttgcaagagctcaggctggagactgagaaaatgctaagtcatggggggtcttacacaacattctagagaatttagactttcccctgtagacactgaggggccgtgaacagcatttgtacctctgcaagatttttctggcagagacatggaaaatggtttagaaggtgaagataaggagctcaattagtgggctatttaaagtgtgcaatccacagataaaaggcaaaaacaaaacctgaatcagaagagtataccagaaaagggtgccagcctattatatatggcaatttatgatttatttaacattgaaggaaaaaacaggccttcaaaaataataaaataagaaggtgctagctatttacccctataacttcaggtacaagaagaatatttttattttactgagctcctcaactgatttaaaaaattaatactcataccagattgtaaataattcaaggaatcatagccccttccttactttttttacatttgtaagatttaaagagtcatacacccagataacatcaggctgcagagttttagagaccaactccttcagtgatttttcaagatgagaatgttctccatgttctcctgcagaagcttctctgggagccccaatatgtacaagagacagaggtagaccactggctgtgccttccctcctcctcctccccattctactcagctctgaattgcagttgcatagtttgcaaacttaatgttgtcaaaccttgttattccataatgggggcatagttgtgcaaactggaagtgattgatttacccagggacagaagacttggttaatagtagaaaaggatccctaggttccctaattgttggacaattgctcttagcagttttggttaacctggtttttatctggcttctcagtagagatgattctttcataagatcacctgcacacaaccagctactcatatatttgcttatatgtgtcatatctgatttatgtacattttctgtagacaagcttgttttaggtcatgtacttattacttactaagtgtttgttttctccatacttggggatctaaattagtaagcaacaaactgacttggtgggttcaactcaataatatccaatgaagccatttcttcccattcctaaatcctaatttagctgtgggaagtttggatcaatggaaattaaactccatatatgccaacactatgggttgataacctcttccaagaatcattgcctgaccatcatgttccttctacctgaccactccttcctgcacttttatcacatattactctaagggatcatgtctaactttttgtcttcctcaattagactgagtatttcttgaggccaggaaatgcatcattttatccatagcatctaactcaatatctaatgtgtaataaactcttaatagaaatttacttaataactagatagatagtttaagatatgcccttgatgtagtcaagaagacaaaatgtatgggtacatttccttcttgtgtctggttcctctttctgcattgtcagggcaagttttaccctctaatttcttgtggaccagcagctgtcttaattgacagtcccaccaaaccctggatttcataggatgtcccagacaatgagaaatggcttgaagatagaaaattgtctgtgtcttaaaataatcttctataaattatgcgtattaacacagatatgtagcaaactataaaggttattttgctctgaagaggaattcagaattagaacttggatgtagcaggacacctctgttctcattgccataaagaaaaaaaaaacaccttttatattgaatttcagtgaaccttgcagccagcatctgtcccattaattttcatatacgagaacaatgtggcatgattactcaccagcaacagaagtagcagttttataaatcttatgttgtagtggctggaagggacagggttgtgctctcattgtttccatattctttgtgaaattcacctttgcagggggtggtttgctctttctcttccagatgtgcacagaaatatgccatgtcactaaacgtcatgtggcttaacatttctccaattttcagctaatctactgagaaagtagtaattttttctgactagtggtggcctacttctcctataaggctgtcttttacaatgagggaagttggcctcactttatttataaaggtgcacctaaggctggtgctttctggttctggggctgcttaatccaccctctgtttcatttgatcctatagagtttgggggagggctgaacaacagtttcattgacgtgattcagattcaatttgctaagaacctgattgtgtttatgacattaataagaaacactttaagccttttaatacgaatccccagtcactctgcttcttccctttctactgatgatactttgtgatctacatagtttaaactttcattacacaaggaaacttctactaccacttgatgtgtgtgtgaataggctatggggaaaaaaaggttcatttttgtttgagttttttacttttcataggtcattgtcaatgtggtaagtatgctctttagtgggatgatccaacactagggcttcatattcaatatcatttacagaaatagtaaatgtcaataacagctaatgttcattgagtgctaatcttccaggtactgttcaaagagttttacctattatcaactcaattctcccaacagccatatgatgttgttactgttattatagataaagccacttaggcacaaagagattaagcaactagttcattgttacagagttggaaatggaaagccaggtcctaacccaaatgctstgttgcgcacttctctgctgtctgcaggtgggatgagaggtgggtgctgagctgcctcctgtggtgctgttttgaaacctgcccatcccaaagctaagggagtatcgctgtgctaaagggttcagtcagcagccttgccagttcggaatcccctagaaccaccctccatgcatgtcatgggcagctctctgagatttctggtgcctcttactggcttgttaagttggcagatttttctccccatttgcttccttcattataaaattcccatttccattttgcctctaggtagaagctcatggaactcaaatgggaaatgatgatggtggattttcctgctgaaaagatgtacctcaaaaggaaaaaatagtgtatttaacatggagaaatgaaatcctccgaagggagcttcatgaactaaattacccagaatggccttactgtctgttgtcagcatttttctgctgcccctttgagcatcagtttactcactcatgtgtgggtcagctctactcatctgtgaaggtagataataaaacctacccccaaaaggttgcagtgaagattaagtgatgtcatatttttaaaaatgcctctgtaggctctggtacattccaatggcttggtgaatttttttttttccttttccttttccaaagggaattaaaaaaaaatgagagtgagttttgaggatcctagagcaagtaatcccagcactttgggaggatcatgaggtcagaagttcaagaccagcctggccaacatggtgaaaccacatctctactaacaatacaaaaattagctggatgtggtggcgggtgcctgtagtcccagctacttgggaggctgaggcaggagaatcattcaaacccgggaggcggaggttgcagtgagctgagatcacgccattgcactccagcctgggcgacagggtgagactccgtctcaaataaataaataaataaataaataaataaataaataaaacagcaaagcttctatgaattctccttttagcccttcatataagtctattcttcaggagccagtttatattttatggttagatacacatattaaattattggtatgtcagatatgattctattagtagtctccagggttcatagcttgttagggaaaatcctcctaaaaagaagttctttttgtctattcttcattaacttatttcacttgtaaagcattaaaatgggtcctctttacatattatgttgttttctaagggacaaatactagtggttattattacagttctttttttcatgtttggtacttcagtggttgattaactgtttcttaatcctgaaatgtggaggaggtttttgcaagtggttgtagcctggttttgaatgaaggtgaaaatgctctttttgttagctctagatcagcagaggtgaataagcatcatgaatttaggagactggcgtttttttttacataaaagttgctttgttgctaattagtagattagaattcctttaattgcattctgaccaaagacttttgggtgttcaggagggcaagttagcatgtgttgcatttgaatttatacatttgagacacattttcttactgaagctgatattcatgaagcagaaaagataaaaacttgtacatacctttttatttcttgattttaatgttgaagttctattctcagaatggattttataggcaacaatatgcacttaaatttatgatctgtttacgagacctcactgtattttgacagaggtcaaaataagggaaatcaatcttggttctcattccaaagagttttttttcctgatatcttaaaaaggctttattacattatgttgatatccatggcagagagttccaaagacatccccatgaaagggctataaatgtgaggtttgaaaccaaggcaagtcaagcagggtaagcaatcttttcacccaaggttttaaaataactgctgataagaccttctcacagattttcattcatttcttcctagttataggcaggaaattctgaaagcaggtgaattctaaaattaccttataacttgatttcagaatatagttacacaaagtgagaataactcgatgaggatgctgtttggatcttgagtactgtaagtcctgtggtttaattgacgagttgatggatttcttttatgcctaaattcaggctgaaaggcctaaaggccacacgaggcagtttatcacgagcgctattctccgtttttatattmtggttcattaccagccccttcctcagtacttctatttatataatgttgttctggtcaaggtttatactaaatctcttttaacttcaacatccaacaaatatttttaaggactaatgtgtgcaaaacattatgctaggtgtttcctaaggcttcaaataacttggatgccagttttggactgtaagtgctcacaggataatagaaaaatcttgtttgcaaataactggaacataatgtacaatggaatgtgtcataaggggagtgcacacaatgctgtaggaattccaatgaaattcaccctcatctttcattgtattccctgttatttacctctccttaaaagaaagaactataagaactctacatcttttagtggcgatttcctagatagaaaaataatgaatattaaacatgatgtgttaggattggtgaggctgaagaaattctatgcattttgtcatttagtgaatatgtattgactgcctgcctattcagtgtcaagcactataggtggtaatgtatcaagaggttcatgaactaataataaaggggcacctctgtatttcacaaatatttgctgaatgaatgaactcattatattttattctcctatgtgattcctagataagttctgctacctaaaggaaagcacttatggaatccaaggtttggaaagggcttgaaagatcacattaataggtttcccttttatttgcctttttgaatctcaatatggaataactttgacttatccatactaaattgcatctcattggtgttacacaatctttccagtttttcaagattatttttaacttatgccaacaacatattaaatatcctttccatctatgggacccattccattttctaagtttacctaagactttaaaagacattaagccatcagagccaaaaacagagtttctctacttccatgttgatattctccttaatctacacttccattcattcaataaatatttactttcagggtgttcggatgagctatgggttacatagtgatgaattcagcagacatagcttctgccctcatgaagcttacagcctacaactacagaggatggggctgttgaagcagctaaaaaaccctaccttttctactattgagcaataaaagaaatgtttttcttgaatttctgagatcatttcttgccagtctttgctcatgtcactacctggaataaactcccttttatcatattgggttatcaacatcttatacattcacaaaagaccacataaatgttaccagctgcaaaaatcttattcatgtctgtgaaatccattaacatgtggcaccacttgagttgggctcatcacttgctgatttctgctgtcattatttgtgaatgtctaatttcactgtaagctcatactgtcctttcaaacatgaatgaggcctttaacattgttgtatcaatccataacattgaacataataccctgtttgaggaggcatgactatagaccctttctgtccaataataaagatgttggtaagagtaaataaaaggtctcatttcttgataaactggttagaatcaaggaggtctgagcatgacactagggttcctaaatactttcattctagacacataaaacctctagaagattaaattcagacaattttaaactttagatacacattacaacacaaagaaatgcactattataaattttaatgggggaaggccggtaattcaggaaactgtcagatctgaataatgaaataccagatagttcttatctatttacatactctgtgatttctaacactctgaacaataatatttcagggttctaaatattggttagatttttaaagttttcgaaattatataactagatgactgctctcaaaattaggccggtattttggattacacagagtgcctaaaagtgcatttttcctcctgaaggggaaagccatgtgcctagccaatattttcattccctaaggatccatggaattatgatagcttaccctcatcagtcacccaggctcccattggtgtgaattgggcaatgctgtttacatagcaaatacacttccttttatacaagggtccacaacccctgggccatggaccagtatcagttcacggtgttaggaactgggtcacgcagcaggaggcgagctgcaggtgagtgagcaaagcttcttctgtacctacagccactctccattacttgcatcaccatctgagccctgcttcctgtcagatcagcagcagcagcaaattctcatagaagcatgaaccctattatgaactgcacatgcaagggatctaggttgcacattccttatgagaatctaattgctgatgatctgtcactgtctcccatcacccccagatgggaccaactagttgcaggaaaacaagctcagggctcccactgattctacattacggtgagttgtacaatcacttcattatatatcacaatgtaataataatataattgaagtgcataatatacataatgcacttaaatcatctccaaaccatcccccactgccaccctggagcatggaaaaattatcttccacgaaacagatccctatgccaaaaagttggggattgcagctttaatagactcagaggcatagtcttagagtgtaacaaatgcacaaaccttttcttttaaaacagactccagagggattgaagagagggaaccagtgataatctatatgcccatttcatggcagacatgctgctgtgtgctttccatgcattatatcattcakccaacaggcatctaaagaatatagagtcaagaacagttaagccattgccacaagatcacctagctagtaaatggctcaaactcagtgactcaaacccaggatttccaaccttaaataaggctctcactcccacaccgcacagctgcatatctgagtgtttatcagtgaattacattgatgtaaattcatttatgaaaatgtcaagatatcgtgagcactagtgcttttaggagagaatatttaactcatttcagacaacatatattaacttcatcaaaagtttgcctgttataaacctgtgactcactcttggtcaccatgatggtgcaacagctgtccactggacaaatactaaataatattttatccttgccccctatttcttatgagaaagccacaatgaacttccttttgtctctcatttcacccttaaagggacaaatagcattgcattatccttgaaagggtcttctgctgacccatctttgacgcttccatcacagggtgacgatgggatgtttgctgtatcacacttccctgtgctttcatgaatgtgttactggtgatgaagaatgccaattctttgtttagtagcagtttgctgggtctccctgaaaataatgtgtcagttaggctacctataaatctgagtcagtaatgtacttctctaaggtatatttatgttttgaatttgtctctgagcaatctgttggggggaaattttgctttaatatgttttataaaaaggtgagaaagtaataaagtgtaatgaagataagataaattttctaataaaataaaatatagaagtgttcaaaatttttgctttccccatatgactttgttttttccccaaatgttaccctcataacaggtgggttctgtctcttgatgggtatcaacacagtgaccacaaccgaggaggatttagcaagggaatcttactacttgtaacaaataagggaaacaccaggagcaattcccaaagcagtatctctccaagctggggggcagtcagattttataagtgtagggtaataaggtgtgatctgattggattctgcaatgaggtgttgtcagaaggcataatctgactggattttgccatgggatgatggcagagctcaatctgtttggatcctggatcctgccattgttgtgtctgcttttaattcagtccctactccttggtcagagcacttaggttccccctgtggttgcactcttggttcttccgcacatggtcaggttatgtgacctgagggtccatggcaactgaaaaacaagaggaactttgttacataaaaaattgaaccagatttgcctggcatggctacacaaatggatgtctctgttcagccttatttatccacagtttttcctcctgctgatccctttttcttgcctgtcctccctgcctgctcacttgctttctggcctctcttgcctctcttcttagccagagctgtatagggatttagttcagtgtttcctccttcattgtcattggacaatattcactcatcagctccaggtcacctccctgtcctcacctgtgaccagtcttccttccaggttcattgccattttcaaagtgagtctgcactctctcaccacccgtttgcttatcacccactctctatgtgattacttgtgatttgacatctgcccatgctactacaatgaaatggctttctcagagactatcatatgtctctattgacaaaaccggattagtgctgcttattttctgcagtatttactgttgttggacaccgcttccttcaactttctcctctcttggttccagggcactatactaactttggtggccatatactcagtgcctccttatacatgagtggaagtaaggggttcagaatgaaatgattcagtcagtctcataaagagataggacatctgtggagattaaagttctcagagttagtagtctcattgctttattccacatgatgttgacaaagaagtagaaagggaaagccaaatccttcaatctatattgctaattaaaaaatgattttcttttcttctttttagtaaatgtttgatggtgtcttgggagtagccttagtagcaaaaggaaatatttatgcatgtctttgggaaaatgtctttccattttctgtggttattgtatctgtaaaaattggacaccatttcttaaaaggattatgtgaaaattttatgatgcctggttggtgaaaggcagagtgtcctgaaatatctaaaatgtagaatcatattctttctattgttttgatataattagaagtgtcgattttaaaattacactgaaaggcattttatttttaacattgttttattaggtgagtgcaaaagtaattgcagtttttgcattgttgaaatttgccatttgatatgggaatacattcttatttttaattaattaatttattattattatactttaagttttagggtacatgtgcacaatgttcaggttagttacatatgtatacatgtgccatgctggtgcgctgcacccactaactcgtcatctagcattaggtatatctcccaatgccatccctcccccctccccccaccccacaacagtccccagagtgtgatgttccccttcctgtgtccatgtgttctcattgttcaattcccacctatgagtgagaatatgcagtgtctggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacagtcctttgggtatatacccagtaatgggatggctgggtcaaatggtatttctagttctagatccctgaggaatcgccacaccaacttccacaatggttgaactagtttacagtcccaccaacagtgtaaaattgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcacgtcctacgcccacttcttgatggggttgtttgtttttttcttgtaaatttgtttgagttcattgtagattctggatattagccctatgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttcatggctttaggtctaacatttaagtctttaatccatcttggattgatttttgtataaggtgtaaggaagggatccagtttcagctttctacatatggctagccagttttcccagcaccatttattaaatagagaatcctttccccattgcttgtttttcctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagtttttttcaattctgtgaagaaagtcattgatagcttgatggggatgtcattgaatctgtacattaccttaggcagtaaggtcattttcacgatattgattcttcctacccatgagcatggaatgttcttccatttgtttgtatcctcttttatttccttgagcagtggtttgtagttctccttgaataggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaatagtagtggtgagagagggcatccctgtcttgtgccagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttttatgctggattacatttattgatttgcgtgtattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctgcccggctttggtatcaggatgatgctggcctcataaaatgagttagagaggattccctctttttctattgattggaatagtttcagaaggaatggtaccagttcctccttgtacctctggtagaattcggctgtgaatccatctggtcctggactctttttggttggtaagctattgattactgccacaatttcagatcctgttattggtctactcagagattcaacttcttcctggtttagtcttgggagagtgtatgtgtccagaaatttatccatttcttctagatttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttcttctctgatcttagttatttcttgccttctgctagcttttgaatgtgtttgctcttgcttttctagttcctttaattgtgatgttagggtgttaattttggatctttcctcctttctcttgtgggcatttagtgctataaatttccctctacacactgctttgaatgcatcccagagattctggtatgttgtgtctttgttctcgttggtttcaaagaacatctttatttctgccttcgtttcgttatgtacccagtagtcattcaggagcaggttgttcagtttccatgtagctgagcggttttgagtgagattcttaatcctgagttctagtttgattgcactgtgatctgagagatagtttgttataatttctgttcttttacatttgctgaggagagctttacctccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttaacagtggggtgttaaagtctcccattaacaatgtgtgggagtctaagtctctttgtaggtcactcaggacttgcattatgaatctgggggctcctgtattgggtgcatatatgtttaggatagttagctcttcttgttgaattgatccctttaccattatgtaatggccttctttgtctcttttgatctttgttggtttaaagtctgttttatcagagactaggattgcaacccctgcctttttttgtttcccatttgcttggtagatcttcctccatccttttattttgagcctatgtgtgtctctgcacgtgagatgggtttcctgaatacagcacactgatgggtcttgactttttatccagtttgccagtctgtgtcttttaattggagcatttagtccatttacatttaaagttaatattgttatgtgtgaatttgatcctgtccttatgatgttagctggttattttgctccttagttgatgcagtttcttcctagtatcgatggtctttacattttggcatgattttgcagcggctggtaccggttgttccttttcatgtttagcgcttccttcaggagctcttttagggcaggcctggtggtgacaaaatctctcagcatttgcttgtctgtaaagtgttttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgagggtaacccgacctttctctctggctgcccttaacattttttccttcatttcaactttggtgaatctgacaattatgtgtcttggagttgctcttctggaggagtatctttgtggcgttctctgtatttcctgaatctgaatgttggcctgccttgctagattggggaagttctcctggataatatcctgcagagtattttccaacttggttccattctccccgtcactttcaggtacaccaatcagacatagatttggtcttttcacatagtcccatatttcttggaggctttgctcatttctttttattcttttttctctaaacttcccttcttgcttcatttcattcatttcatcttccatcgctgataccctttcttccagttgattgcattggctcttgaggcttctgcattcttcacgtagttctcgagccttggtttttagctccatcagctcctttaagcacttctctgtattggttattctagttatacattcttctaaatgtttttcaatgttttcaacttctttgcctttgatttgaatgtcctcccgtagctcggagtaatttgattgtctgaagccttcttctctcmgctcgtcaaagtcattctccatccagctttgttccgttgctggtgaggaactgcgttcctttggaggaggagagtcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcacttctgttggagtacccggccgtgtgaggtgtcagtctgcccctgctgggggatgcctcccagttaggctgctcgggggtcaggtgtcagggacccacttgaggaggcagtctgcccattctcagatctccagctgcgtgctgggagaaccactgctctcttcaaagctgtcagacagggacatttaagtctgcagaggtaactgctgtctttttgtttgtctgtgccctgcccccagaggtggagcctacagaggcaggcaggcctccttgagctgtggtgggctccacccagttccagcttcccccctgctttgtttacctaagcaagcctgggcaatggcgggcgcccctcccccagcctgctgccgccttgcagtttgatctcagactgctgtgctagcaatcagcaagactccgtgggtgtaggaccctctgagccaggtgcgggatataatctcctgatgcgctgttttttaagccggttggaaaagcgcagtattcakgtgggagtgacccgattttccaggtgccgtctgtcacccctttctttgactaggaaagggaactccctgaccccttgggcttcccgagtgaggcaatgcctcgccctgctttggctcgcgcagggtatgcgcacccactgacctgcgcccactgtctggcactccctagtgagatgaacccggtacctcagatggaaatgcagaaatcacccgtcttctgcgtcgctcacactgggagctgtagaccagagctgttcctattcggccatcttggcttcaagagcgggaatacattcttacatgtggttatgttatacatcattttaataggtatttctcacttgtttttgctaatgacttactacttgctgtttattttatttttattttagactatgaaagtgatgttagataaaaagcaaattcaagcaatttccttattgtagttcaaaatgggtcataaagcaatggaggcaactcacaacatcaacaacaaatttggcccaggaactaacgaacatacagtgtagtggtgattcaagaagttttgcaaaggagatgagagccttgaagatgaggagtgtagtggctggctcttggaagttgacaacaaccagttgagagcaatcttgaagcttatcctcttaaaactacaagtgaagggccaggcatggtggctcacgcctgtaatcccagcactttgggaggccgaggcgggcagatcatgaggtcaggagatcgagatcatcctggctaacacagtgaaaccctgtctgtactaaaaatataaaaaattagtcgggcatggtggcaggcgcctgtagtcccagctactcgggaggctgaggcaggagaatggcgtgaaactgggaggtggagcttgcaatgagctgagatggcgccactgcactccatcctgggcaacagagtgagactccgtctcaaaaaaaaaaaaacaagtgaagttgccgaagaactcaacgttgaccattctatgatcgttcgacatttgaagaaaattggaaaggtgaaaaagcttgataagtggatgcctcatgagctgagagaaaattaaaaaatcattattttgaagggtggttttctcttattctgtgcagcaacaacaacaaacaatttctcaatcagattgttacttgtgaggaaaagtggattttatatgacaactggtgatgaccagctcagtggttggaccaagaagaagctccaaagaacttcccaaagccaaacttacaccaaaaaaatgttcatggtcactgcttggtggtctgctgctggtctgatccactacagctttctgaatcctggctgaacaattacatctgggaaggatgttcagcaaatcagtgcgatgtagtgaaaactgcaacacctgcagccagcattgttcaacagaaggggctcaattctccaggacaacgcccgactgcatgttgcacaaccaacacttcagaagttgaatgcattgggttacgaagttttgcctcatttgccatattcacctgatctctcgcgaactgactcccacttcctcaagcatcttgataacttactgcagggaaaatgcttccacaaccagcaggatgcaggaaatactttccaggagttcatcaaatcctgaagtatagatttttatgctacagaaataaacaaacttatttctcattggcaaaaaagtgttgattgtaacggttcttattttgattaataaagatgtgtttgaccctagttataaaatgatttaaaattcatgatctaaaaccgcaattacttttgcatcaaccttaatatttgaaaattagtaaaattgcaaaaagaaagcccttattagctgttaataaatataaaatatataaaatgtgtgtgtgttaaactaagtgccttgagtatatgaagctatgaaaatgaagacaacagccttactaacattccatctcattattgttataactcctggttccatcataatcttgtttttccatcccaacagaatctgaggtgcagtcatttttgtgaagctgttattttcatcacaatgtgatctatacctaatgattacattacctgtacatctgaagctcgttcgtaaaccatcgtcccctgagagtatacctaacataggaaatactatatatatttggccgctgaagtgctataatgatgccctaaattacatatccctttctacagacataatttgctttattaaaaataacttctgcataactattgaagaataaaacagccacttatgcacaaggtgagggatatctgcatatctgagctagacaaaaagtatgtttgataatctattgtatgttttgctacaaaagcaaagtggttccttatgattggctgaaactctttgagttcttgttctatctttcagcaaatgaagatgctaattgtctttattctagccttttataacattaccttggctcttcaaagtcaaatggaacctggaaaatcgaacttaattccattttacatttttcccttgaccatttcccatggtggggaggtatgtgtctagatttggaaaataagcctgcttagttttttttcccagctcagtgcttagaaacaaccccctctagcaaaaccatgcctaggaaaacaaagtatccagctaggctttcaagrttacttgggggcaagacatggatagttacgtccttggaggaaaataaatacaaggcagtagatccaaatgtatttgtcatgcaaagaacattagctgagagagagcttccatatataggtttgcaaaactgagagcaaagccaaagccattcctgggttttgctttgtgatatagtctccaaatggatactattatgattaatctattctgagttccttaaatgctattgtaacaatgtcaggggccaagttcaagtctaaagtacgtgtatgatgatcatagctgctataatactcataatgctgaagacatagtaacaacaatttataataggagagcagttttgtgcagcaaaatagttccgtggagcagaattagatcatgaaaatgttgcatggtgggcatttagtcgtgaaagtataaatctgtacctaatgattgatgtgaatcaggtttcaaacctattagatgtgccatttaaccaggcaacatttgcccattatttttttgcatgaaaagtaattaccgtatgtttaatagttactgaattgtgactggcaggtgtgccccaccataataataatgatgacaataataatatcttcaacttcaactcactctccacaagtcagggcaaagagagaataaacaatgattatttggcgtgtttgaataatataaaagccagtctaggtaatttaaggcaaagatcactttcaaaagccagatttatatatttttccctcctccattcaaataattgtctcagagtcccatttcaacttattttaatagttacttcctgcatatctgtgatgggttctcaaaaactttcaaaaccactttcacatattccgttacttagcccttaacaacagtgtcgaatagggtaggagagaaacattgttccctgtttttcatttagaaagccgagattcagagaggttaaatgactgtttctactccacaaaaagaaagaaatcagttgaattttctctgataaacctgccaacgttagtgatacgaaagtgaccacaccgatagagtggtgtcactgtcaatattattctgttggcaaacatattgtatctggaagtcaagggcaagaaaagaaagttagaaattgctgagataagggctgtgctaccgaaaaaacactgaaagggtgccccagctagggtctcaaacctatacctctccccttcagcctggtacttcaatactgagtagattatggtgcccattttgagggaaggctagtgttatctcattcagattaagttttgtgttggtgtgacacagatgggtttatataattaatgtcatgtcctagagggctgtgaacattcctacacttgaggcagtgttcaaaatctattactgtttttttttaattaaaaaagaatttgttttctttttcccctagatggaacttaaactcattgtatatgattgaagaggaacaaggagaaggagaaggagagaaacaacatacaataaagttgtccaccaattgtcccaggaaaatttgtttctcacataggggtcatcacaactgctgcattgcagtcagctggaagtataatcttccatgaatctgaagatgtgatgaaagatagtaggcacaggcaaagcctagctttaagaaaaacataaaatgaggactttgagaccctagggcctctttccttcttcttccccttgataggcaaaggcttttttccaaatcatctttgtaagaagtcccagacccacaatgaactattgaaataccatgatccagtaatgtcatcttcttctgctattaatatggtaatcattttaggtgatagatttcaccttcaacagttcttgaagaacattcagacagttcaccctgaaatgggtgaaaaaaaatcaggtacctcctatttcataaggatgtgagccaggatgaagcagtatgttatcaggcttggcatttcgcaagctgagtagagtccatgtgatcaccaggtataatgttatgctggagttgggtttcatctcttgcttgggtttggaatgtaaacaatcttgaaattgtatttggagagaaggaaaccctgggaaatgtttatttttaaaaaacatggattttttacaaaagcaaatacatgttctaatttacatcagggagcagatacctctttacttttttgagatttttctgagacattaaccttaagttatcacttgtgtgtatcaggagaaaagttgggagagtgggagagatgggtaaggaaacatttttaaatgtacttaaatctcccatgatttatttcaagctgtaaagcatttctaaaactcgagtttgttaattatcccaaggaaaaagaagagaggaaaatagtcaatctgatagactggtgacattccatgtagcctgatactaagttgtgacaaaatatctaacattcggccattgtttttgatatttgtactttttcttgtaaactatttgctctgggacaaaaagtcattggttttgaacttgatttgggcaactaaatgatatacttaaccacctgctttagcccgaccatgactttttaatgacttccattttatttggttttggaaattgatttgccctttaaaaataatatcagcatttaaagtaattttgcttgttttttgtttgtgtagtagctaaatatgctaagagaatgacttcaaatatgcagcctttatgaagatgtgaaaattgctgtgctctagctacaaatggcaattccgataacaagagcttgaatgtggccttgaggcaagggaaaaacagaaaaagtccactgaaagtcaactttgtccccttaatttgcaggcactgtggggagcagggaatactccatgggcacaggcatcctcccgagccatattggttgtagtgttgtctattatatctgcacagttcctcctttgattctttctatgaatcatgtgttagcaacccaagtagctgccattagctccagccatatgggtgaaggtaggggtagaggttgcagagcttaaacataggtatccagaaatcattggctcttcccatttcctgactgattctccaactatcaatctgcttgtaagcacattcacaccactcagtgcccctggtacataaaacaagagcagtgactgaaataagctctcaaactagcaaactgaacaagctatacaagacttcttggatattgaaaatactaaacattctcatagctatagaattaattatttggaagatattggcaagtaccttttcatgtctacagtgtccatctattaaatgggaactactactctgaaagtagcagtaagttttattaggggaagggggagaatcatcacaatcatctaaaactgttttgtttaatgttacctgccaagatatgtgtctaagaggctgctgtggctcccaccagccctgacctctgcacatcactgaacctgtatcctactgttaatgatacatatgtcatatttacaaatgcctcatgtgtctcagggtggtaaaaatgtttctattcaagaatggcaactaaaaacacccataggtccatcatattggattaaccacttatatccagctacctgaaactactggcactactcagaaaataaattttcttttaccatcttgcccacttaccgttctcagaaagtcctgcctttcctttcccttctttatccaattaacccaacttttagctcttacatcaaatcttctggaaagccttctagacatttctctcccttcctctctgccattatttctttttcaggataggttagatattatactgggcgctctcatagcttcatgggcatacccatgtcaaagtagccagcaatcgctattctaagaaacttgtctgaatttgtaattggattgtaaatatcttgagtgcaagatcttcaacttgtatagttgtatttccaattttcaacatatgttgagtgaatgtattctaaatataatattaagcatggcctatacctggtaatataaacatggaaatagaatgattatttaatttgtcatgtctgtgaaggacccttgatggtatctagtcttaaccctcaacttacagttgaggaagctgaggaccatagtgtattcattcattttttgtttattaattcatgaattcattcatgcaacacattgcattgagcatccatgtgtgcttggcactgagctagccactgaccaggtaatgctaagtagagcagaacaaaagacatggtccttccctcatagagcttacctcttagtgcagtagagacacagtaatccaatcatcacacaagacatttatactcaccaactgtgctaactggggactatggcagccaactgatgtgaagatttggcttaatggcaggagtcaggaagcctttcctccaaggtgtggtgtttgaactgaaatctgaagaaccagcagaagagcacaaggagggaaaggagtttgccaggcccaggccagtgggtttgaagccttgaggcaggggggaatgaggtgcattcaagaaactgaaaggcggaaagtgcaggagcagaagaatgagggactcaagaagaaagaggcagtacaaaataagaatgaaagatggtcaggggccagttctgtaggacctgtagccatttaaaaatgtttagttattaacttagaacagtgagagcactgaaatgtgtgagggtcagaagaactgggaggtggcctgataacacatgcattttgaagaatctctgctgcagtgtagagagcagattggtggacaattgatggactgagcagataggtgagaggtagccctactgggaagaatatgctgaagtgtgtgcaagagattttggcagcctggagagtagagagcaccactgacctctctgttttttctaactttctcaaaaatgctacgttcacctacatcttatcaaagaaggcctttatttacctatacttctagcatgctttgctttagattttcccatttctcaggtaagggcacagaggctaacgaacgctcctttcctggggccaaagcgttttcagtttgggcatctcagtaacttttggcaccactgctggctttaaggagcctgttatgtagtctatggtggatctgaataccaggcagacagatgacatttttataaatagtgtgaggaaaccccagaagtaatgtgaatggatgagagttcaagaccactgctgacctggaaagccaatgactgaggcaccagaggaagtaggctctcagagggaagacagaacaccccctttccagctcattgagagtgaagcaggtgcttttctgaagcaggtgatattctgaagatccacctcctcagaacaagtgttctgaagtttctctgaaatgcagagaatctaccatatgatatggttttgctgtgttcccacccaagtctcatcttgaattgtacttcccataatctccatgtgtcatgggagagaccttgtaggaggtaatttcatcatggggggcagttacctccatgctgttcttgtgatagtgagtgagttatcatgacatctgatggttttttataacagggttttcctcctttgctcggcacttcttcctgccgccatgtgaagaaagatgtgtttgctcccccttctgccacaattgtaagtttcctgaggcctctctagccctgtggaactgtgagtcaattaaacctctttccattataaattacccagtctcaggtatttcttcatagtagcatgagagcagactaatacaccatctgtaagaaacttggaaaaatgatttgtttagagttccatctgagcagtcatattattagtaagatatatatgtcgggaaaagaaatttacttcttatgactttttacattttgagatcttattgtttgatgctccacgttgagggagccatatttctccacctggtcaccaggctcattaggagggacagatgtggcctcacatttcatgtgcggttcttgtctcagcccttctttttctcaaagattcctgccttttgtctacttttctcaaagtgccatcttccttctctcaggctcttttgggattacccaaccaccattgtaggcaactctagttctataggcaactctagttctataggtaactctagttcagtatcatgactttcatggtttctataaaaattgccatcccacagccttcttcacatctgtgacaggcagttgagaggggactgaggaaaagtattgcccatacatggaatttgtggagactcaatcaatgttacttggattgagtaataaaggaagttatttgtctaagtttgggcagcaagagaatggcagggacagaaccaaaagcagtttttaaacgataatctttttttatttttttactattaaatacagcttgggggcaaagaagagggatacaatttgttgactttcattgctacatttttggacaaggaaagagaaacagagactcaggactgtttagaagtccaaatgctatttatttccccatactacaatggctgttgaaaattctcctataatatgctacaaatacaagtgtattagagagtttattgtgtatatttttgaacatagtgtaatttcttgtatgatgttaatacagttcttgttcttattctctgtaagagcttgtgttgctgttatctctagataggagcaaacttcataaaatgtagaattccctctgcatgcatagggaagtagcttttaaaatattagcctattccattgtttagttataaagtaaaatgattttttaaagtgcaggataagtgaatttttatgtttcatttttagttattgaattgtctaggtaatgcattttaggagggcactgttcctcccagaacttaggaaagcagtcattcaatcactcagtaatttttagggatttttaaaatagatataacaattttaggatgtcaagttttagatgtctagttttaacttgtttggttgagctgacatttaagttcagtcccaatgtgatgtgaatggacctagccttttacctcttctttttttcctcttcattggaaaccagtacagagaacayggtcacttaataagaaagatgtttcctgctttgtttccttttattcaactcagaactgcctgggggaaaagattgcttcctttctgaatgtggtaagccacaaaatggaaaatgtgcacacgagctctttcctattaaccttggggaaaggtgacagaaatgtgtgaacaatgctgttagctgtttaaatgttcttttattattattaatttggtttaagggttttgcctaacaagtaactcccttgatttgtatgtttcagagttgtttaatttttctccaaaataacaatttgtccttttgaaattctttgttagatttatgtcattccagtttcaatcttggtgatgattcttctatctgtcatgagtggtttaatctgcatgtttataattatagcatataaagccacataattcaaggtgggtcttggtatataattcctttgtactttttgggaaaataaggctgtaatggaagtaataaagatacctgagttgggaatgtttaggtatcaccaaatattagctgttcagaaaaatatccatgataaattagaaactgaaatcagcacatttttctggtttcggttcttttggggaaacactgttattttttaattcctggcttaagaattgtatttgattatgcgaagacaaatccaaaattttaaattctaatccaagaccttagataaattagggaattagggaatctgtgtatgtattttataaccatatcaccatatattgacatacctatgtcactgaaggtatattgtaaaagataatttggccaactgtattggaccaactgctcttgaactctctaagtacaattggtttaagatattgcctgaaatgactattttgcttatggtgtcattctttcatggtcaagatgacagttctctaggaatgttatttcatttctagaatgtcagccaaacagctttttatgatcctgagcagttatactctwmcatcccaaacacacacacacacacatacatcttacacacacacacacacacacacacacacacacacacacacacacacaaataagccctgagaattttcagagaaattcatggtggaagatctgagattagaacccaggaactcctaagattccttggttttgtatcaaaggtcaataaagagacatgaagtcaatgaagtcaacaactgagggaaacatccctgaggaaatgcataatggaagtgctggtgtaactacctcaaataaatatttctactgaaactgatcagtcatccatttgatcaggtaaggcaggcaagcccacctctgattgcgtagtaattcactgatcattatcctgatttcagtggatctatgccatactcaagacctacatttgtcagtgacctgattgtcttattgccctacacagacatataatcagtccagcctgtgtgaaactccttgtgacccttatcatcatacttaagctgttttggtctttcaaatgtattcgctcttctttaccattttgaagccatcactctttcaccactgccagctagtcttagtaatctttcaccgtgcactgtctgttgcctcactgaatcctcacagtcattctatggcataggtaatatgattgtcattgacattatgttcataagggatccaaggttcagagggattgtattgttcagggttgcacagctaatttctagtaaagccaggaatcaacttgcgtctatatgattccatggtctatgcacttagctgtgatgtatgcgttctatctcaagtgatcacctctaaaatcaggatcagttcacagatatttgtgagtctctcaagagaactagggaaacttctgtaaagttagctaatggctttttaatgttatgtggtaattgtggtgaagcaattgtcaattccagttaaattagcttaaaatgataagagcaaacacatatctttgatgataaggctgggatagaggttaatgtctcatcaattttgggtctctcttagatgtttgaccttatcctaacaacttaagctttaggtaaagtctgcatttggtactctaatctcttcctatcagacacaggtgctcttctctgcccaactgcaattcagtccaagacatgccttctccagttagtctctggagaatgttgttcctacttagactcactgcatagatcttaacttgtactcctgctggtggtgtgcatatatgagctgtcacttgaccatgcagccacacctggagacccatttctaggttcagagtcatctctgatgcagcctgtaatttccccactagcatgccactctgtaggaatgaaccagacattgccacatcattctatgtagcattttcttaaaattagagcttcactataaacaatctttggtcaaggaaaggctttgttatctactccatggtctctttgagaaaaaaggcctggtcccattaagctcttgcctcgtttttgcctttcagggattattcgtgctctgtgttagatgtgaacttttggttaggtacataggaaatatctacctaagacacttgtgatttccaccaagtttgaaacagcaatctaaaagctaactcattcattaaatgatggaattgttaagttggtataaagtgatggtacaaaagcccatcagggcaggtttgaaatctaaatgcctttcagtatgcattgaacatgcgcatccatgagaaaatagtatgataaagaaagcagggtgtgaccttattggattcatatttccttatagaacctccaaattaagacaaatttccagacatttctaaaagcagcaatacaatcaagaaaacaaaacaatgagattcagtatgtagctactgcaaatttgtcagaaaataagtgggaaaataacaagatcctaggaaatctgttgtatggagctgaggaaaaggaatgagtttaggtttttctttaagttattgaagaaggcatgggattatcttctggttgctagtcttcccttagtttcaatgggaaacttatcagacacacttatcttgcagaagcaagataagaggacaaaagaatttggaagatcatggtggaattaaaaaaaaaggaatgtagtcagatggtaaatttagtctaattatatttagagatgggttaacataatcagaaggtaaggaacccaattatgagataggtgtgataacatagatggcttaataaaatacaaaatagaaagatataaatagaatgcttttatataaattctggaggagtttaaaaatgagtgagtgttcaagataacttagaaggaaagatattaatataaacttgaggtatgttggtcttgaagaaaaatgaaaaagctcattttgtgaaatgagtggaagaataccagctctttttcagattttcaccattttattaatattttttgattatagaattttaattatgtaggaaggaatttattaaaaagtaaacacaaaataaaaccaatcatatagttttggccaaattgttgcttttcttttacttcatttcctaaagggcatttctcagagtcacttgaaagtaaaacttgagagggttttatttttttgatttatttatttattttttttagtggctgtttgttgaaaaaccttgttgtaggctgctaggcattcttttactaagaatttcgaatgcacctcatgtgcaaaagactgcttaagtgtgtcactgcagaaactagcaggatttcaaaatcaaactcatcagttttctgtgataggatgatggtttgggagatactcaagaaaggagtacgtgttagtagctgaagatttttctgtcttcttccttgtgttgtcagatccacacttttattttccttttttttttttttgagacggagtctcactctgtcaccaggctccctgcaatttctacctcctgggttcaagtgagtctcctgcctcagcctcccgagtagctgggattacaggtacgtgccaccatgcccagccaatttttgtgtttttagtagagatggggtttcaccctgatggccaggatggtgttgatctcctgacctcgtgatccacccgccttggcctcccaaagtgctgggattacaggtgtgagctactgtgcccgtccttgttttccttttgtcaagaaagccagacattctgtgacacggtaaatgaaaaagggcttggacccaaccccagctctgttgcttgcttgttgcgttgccataagagaccctcaagaagaayctcacaaaatccactgccctcccttagtctcgctttcccactaaatcgctccatgcaaggggagccatttatattgcattaaacttttctcggtgttctctaattccaggggttcttactgcctgagagggtcactccaccatgtgggtaagcggggtgtccagagtctgcccataggccatcagcatcagtttttcaaatcctgggactttcactaaaaaactgtggttcttattttaaaaacaaaacaaaccaaaaaaactgcaaggaagcaaactccacaaaacccatcaaaaccccaaaattttcttaaccttaataacttgttctttttccatgcatatctaattcctccttttaaaaaatacctaaaaaattgaaattggtttaccacatattcctgttggcccacgacacataatgattaatattttttcctttataaaaaattgattgcttttactgtgacaactttgacaaagtctttcaaagagggagagaaatgtgaattcaaaaggataatgtggcttttattttttttactttgatcctgttttgtgaagcattacctaggttagtattgcctcatgttaatcagtgaccataaaggccattaggatgccttgatagatgcccttggtctcccttgactttgattgaagcatcttaaaggcctgtatgcatgtggcacaacatctaacattgtaattgctcactcagtagctctgagcacttactcttcaataaattcttagatgccgtggggatggcgaatgaactttttaattacatgtctgttgttttctatcaccaggaactaaattaatgggaaattagttcacaaggtttattatgcattttccctctttaagaggggactctttctgacagcccttccacttttatccttttaccatttttttttattggcctcagtactgaaattccttctttcttgttccaactacatcagaaacattcaatagacttagcagcctatgaaagtctgacaattacttcctcacggcagccttgtttcaagagtaggtccagaataaataaaagtttttcattttcctggtggcatctgttagttttcaacattgcccagagaaagagttactgtggaatacaaaaaaatgagctatttttttcttccttttggggagaaacagacatatagaaaaccatgagtgcttccttcataaatcatattttatgtgcaaccagtaagagagagagatgatgatggttgtggaaaagtcatagtggataacctcaatttattcagtcttctgagataatgtaagagtaaagcatggaaacaggaatacagagttcatcataattatagatcatccattcaaaacattttgaaaacagtgctatgtaaacttgggatgacaaataatgaagcatagttaacacttctcattggttgtgaattttcaaatacatccaagtatttaatcatggccattcatcattctgtaaatcaaaactaggtctttgaattctctccctttcctattctcagattaaggcatatttggtttcatataaaatcttatgcataattttgaatttcttgggccaatcaaataatggtacataatttaatttaaaaaacttttcagaaggagaaaactcatgtttcacatacttcttattaatcctaaggcctagcaaagggtacatacagctgtagttcacctcaattatacactgtaaatatttagattagagacacgaaataagttttgggagttgcaagaatagaatcagatgtaggaggtattcttgtagaatagagatggagatgggatttaaaattttttatttcactgctagagcaataaaatcagtattaaaaacaaggagaggctgggcacgatggctcatgcctgtaattgtagcactttgggaggctgatgtgggtggatcacgaggtcaggagttcgagaccagcctaaccaacatggtgaaaccccgtctctactaaaaatacaaaaattagccgggcgtggtggcgtgcgcctataatcccagcaacttgtgaggctgaggcaggagaatcgcttgaacctgggaggcggagattgcagtgagctgagatcagaccactgcactccagtctgggtgacacagcgagactccgtctgaaaaacaaaacaaaacaaaacaaaacaaggaggggcatgggcttggattttcataggaagagaggctgagaagaacaagaatgctgacatttgttttgtgaaatgggtctgaatgcctataaaagactagcaggtactcagacatgcctgtcaccacttggcagcaaagcaaggaaataggacagtattacatttgtgaagttgttgatcagaaaactagtgtgcagaggaatttgtgtgttttaaaatattcccaaagtggcagaatattactgacatttgaaacaatagcacagtctacctatgttaaaatggtatttccatttttaaattatattttttcaataaaagtcttgctctcttcttaagttacagatttttactttttcattttgcttgttcctgtgctccttgatccatcaatgaaaatgtgattttctgttggagtcttcgataaatatgtaaggctattttcattgcatcagaaagctgaaagggaccttggctgatcatttgtgtaattgaatcgtgtctgcgtttagggcacaattttcattttatgaaagaaacacaagatttcccatgatgttttgcatgtctacaaattcaggcgaatgagtctttcctcgggctcagtgagatcagtggggtcatgctagtgaattaactggcatgatatttgcttaacaaaagcatgccataaataagagacttaatagtcagttggcaagttgcttcatgctaatgctgtttttaaaatttaaagtaatggatgaaataaagttttatatacatgtctggatttttgaaaaataagaagatttgaggcatagtgtattatagcagaaatgtcttttaatttatttttagttgttttgggtacatggtaggtgtatatagccaaaaaccacaattacttttgcatcaacctaatatttacagggtacatgagatgtgttaatacaggcatgcaatgcattataatcacatcatggagaatgaggtctccatcccttcaaacatttttgctttgtattacaaacaattcaattatacatttttagttttttaaaaatacaattaaattattattgactatagtcacccagttgtgttatcaaatagtaggtcttatttgttctttatagctatttttttgtacccattgatcatccccaccttcccccaccccaaccctcccactatccttcccagcctctggtaactgtccttctatttccatgtcttttaaagtgtctccctcatttctgtgtacatgtgactcactggggaataaacagggaaatcctttgtgatgaatcagatgtcattctgagacacagagcttcttatacttttctttaaaatcatatttgcccttctagatcagtatcaagcaaataacaaccaagaatcaacatgcataaaaatgacaaggttatcccagagttctagttgtcattttcatagttgccagcacccttttccaggaaaacaaagagagtggccatctaagtgatgccgttgaggaagctgcctttcccctaatttctggagagcctagtgtagagggagaactcctgcctctgggaatatagcttttagggcatccctttatccattctccaccattccttcagtgaaggaaattataaaagcaaaactgggacccaaggcatgctttgagtctctttgcctcagcccgggcaactgtattctccgaattgagttcattaatattgtcttcttaggagaaatattatctttctccagactgggcagggagtctggcttgagaggcaacaataaagaaagaatatgtcttcctctataaagaaaggccactttataatgaatttcctttagatcacgaacagcactgtaagacccagactgtcaacttgtgcttttgaggttaggagctgagaaaactcttcttgattaataattgagacctaaacatggcaaaaaacaggtctgcctcagcacggagatcatgcatcgaggtggcgggcgatgccttcagtgggttctcttttcttcctgtctcctctgcgattatgtggcaagtttagagtcaactacaggaggagtttcagacaagaagcacagtttgatagaaactaatttctggattgtgattgtgtgagacctcctgggtgttcctgagactttcggaggatgattcttggccttgctttgtttttgttcttttcttctttaggttttcatctgaaggcaagtaactcatgtccctacaaggaaattcccctgaggaattagagataagcatgcatttctcaataaaacattttcagaaaaaaagttgctgtgtttccgggagaagcagatggctgctattgagagacacctaggtttgtgttctgggaatctgtctcctactcatgatagcagggggcagattcagatctgcaggaggtagaaataggcatcagatcactctgtcctaaaaaacaaacaaacaaacaaacaaacaaacaaacaaacaattggaagaaatgaattgatcacagaagcatctagagctaggaccaattaaaagtcagttagtttatatgacctatttgaagatttctcaacaatcttgacctattgcttaagagcacaacatttgtagtaaaatgagcctaagttaggatatgacttaagatcactgaccagctgtctaagcttgttagggttacccaatattgtgaaacttcagtttccccatttaaaaatatggaggcaataatagcaattacctaactggttattgcaagcattaaaggaggtcatcaatttctgtttgaggttggaaaatccttcaaaagctttctattcatttgagtaacaagcaaaacattctgatttaatatctgtatgtgcttcagtgtctttgattatcacatttagaatattcaatattttacttgtaatagtgaataaaaagtttgctggttgagagagtgaataaatgggtgaatggaagagtaaataatgactcttgtaacactattagttatggagtggatacacactagaccagtggggctgagaaaatttaaaaaatattcaagcagtagaaatttttacttaataaatattgcttgggaggctgaattaatgataaaaataaatgttttgcatttgacattatctacccaataattcacttctctctgcattctctcactctcttaaagaagggtaccacattgatgatgctaaatgattcttgtagaaccagccagaggtggaaaagaaagtagttctgacacttggttaaaaaatatacatatacataaataaagtcaaactccactgccatctctactcaaagtgtgtgcatactttcttaagtacacgctgagatgactcattttacacttctttttttacatatttaccctgttttaatgggttggggaatggcaagagcaaaggaaagaatagctgattaccattcaagacacacatccaaatcacataaagaaatctttagatctgagaataattgtgaaaagaataccaaattccagtgtagctttaaaaagtgcaccgttatctttaattacctgcttgatagaagaatatttattttggaataagaaggaataatttcaaagttgatggccttgttataaatataagcaaattaacttttttagaaagccatttcgaactccgaagacaccagcaacatttttattgattaattctttagtgttataacaagcaagttgtttttatgccgtatttatgagctggtatataatcacacatctcaggggtggagaggaccttaagaatcatccacttcaacagcttatttgaaatgtgtttgtttttatgttctgtatatattctgttcttttggttatctctctctctctgtctctgtgtctctctctccatgtatgtatgtgtgtgtgtgtgtatgaaatagataatatatataaattatcataaaagtatatttacatatatattttaatgcccactctattggacttgtaagaaaatcttacttctataaagtactctagaggcatatacttgtagcttattttgtgacatatgtttggtcatacatctaataacaaatctttgatcaggagcataattccaattagagcagtggttcttgacagcggcagtgttccatcctaggtattttatacatgtatcagaattttattttatcatctcaatgactagtaaaaggcaaggttgctgggtgccctgtgatgcatgtgacaatctttctcaaaaggaatcctcctgcttctcctaaaatatttgaatgacccactggattttgatgtaggttagagactgtttataatcatcggagcctagattttattttacttaaatcgcagagtactgtttttgctattttaatatgctgtaagttttcccagaaaacaacttgtataaattgacaaaacttattttgttcagaatttttccaggagatgctcaatatttcagaaaacgacctatctaaagrcaatagtgtttgtggcatttaagatagaaataaagtacaaaccgtcagtctgcatgcaaactgtagttactgtattctcacgattctaattatgggtgcaggcacccaggactttgctatgttttcaaatatagtttttttctattgctatatatggaaattcttataattttattctgaattaataaccttacatcttttttatgatatacttgggacattatattgatttttaaattttgtatacagataggttgtattatctataaatttcaaatcatagatgatgtaacttattatgtctatgataatgaaagaggcattaaattatgtacgagtgcaataaggagttgcgtttgatagggccaaaaagccctgaaataaaaaagcagtatactcaggggaatttgctacatcttctagtacaagtagaattatggggcaatatactatttatcgattgttatatagtaatatcgccacaaactgagtggcacacatttatcatcttagagtttctgtggttcaggagtctgagtatggtttagctgcaacatctgcaaggctacaatcaagatggtggccagagctgcagtctaatttgtaagattggctgggaaaggatctatttcatgagtcatgcagttcatgtaggaatcgaggtccttgaggcctgttggactacagacctcaacttgttgctgtctgctggataaaggcttcgcttacttcctcaccgtgcagctctcttcagtatggccacttacttcattgaagccacaaagggagaaagtctgaaatcaagacagaacatataatcttatgtaatgtcatcatgaaagtggcatcctgttggcggagcttgcagtgagccgagatcgcgctactgcactccagcctgggcgacagagcaagactccatctcaagaaaaaaaaaacaaacaaacaaaaaaaggaagtggcatcccattatctttgctgtattccattggtgacaagtaaggtatagattccacatgtactcaaggggcacgyattacacaagggatgaccactcacctgcaaggataattgaggaacattttcgattctgttcaacacagccaatttcctatagcagtgttaggtggaggggatgagttattgggatcagaaggtagctagtgtgttctgtagtctttattccaatgaaagataactttacccattaatgtgaagtcaattgtactcagagaagagggaaaactagattactagaatgtaatctgtttaagtcttgtaagactacaaagtccttactaatttgatgtgcatttctctgatgagcatttctgtagcactggagtccagtgatgcagggatgggttatccacattttctgccactcaagatctttccatccaggtgatccagctagttctcaggcccatcaaactttgatccagggtcagatctggaagaggtagagagcatttttttaattccttatttaaaaaatgtgatttttgtgggtcatgtgaaggtttgttataaagataaacacgtcatgggggtttgttgtacatattattacatcattgaggtattaagctcagtacctggtagttatcttttctgctccgcttccctcctcctaccstccaccctcaagtagacctgagtgtctgttgtttccttctttgtgttcctaagttcttatcatttacttccctcttataagtaagaacatgcagtatttggttttctgtttctgcattagtttgctaaggatgatggcctccagctccatccatattcccacaaaatatatgattgtgttcttttttatggatgcatactattccatggtgtatatgtaccacatgttctttatccagtctattattgatgggcatttaggttgattccatatctttgctattgtgaacaatgctgcaatgaacattggcatgtatgtgtcttttccggtgaggttgcagagaaaagagaacccttacacactattggtgggagtgtaaattagttcaaccattgtgggaagcagtatggcgattcctcaaagggctaaaagcagaactaccgtttgacccagcaatcccattactgagagcatttaagagtcaaatgtattcatgacataaatgtgtattgaaaatctgatatgttttagtgattgttttatagggagggggcagagactctgcttttatgaagcttacagtgagtgccagccaccattttagcttttgggggccttctctaagaagggtggagtagttaatgtagacaaacatgggttttggmagcatacgaccatgaattaacattatatttccgcttaccagccgtgtgattttagcttacgaaagctactctctggttgtttatttcttcaagtgaagaaatgggtctaatagtacctatcacacaagattttctgtgaagattttgtgagatcctrtatattaagcacccagtgcataggtgttctcaatgttaaatcccctctccatgtctgaaccttcaataaaacagactattacaaattacatatgaagactttgatgtttaacgtcatccacacaaagttaggcaaaagtcatatataacaaatatttaagtaatcacctggaacaagatctctttagttattttttaaatatgagatctcacaattattctcagcatttcctgttcattgttttgctatgggtagcatgtcctgattactcagttatacaaaatatttgaatggcttaaaggagtatttgtgtttgacagcataaataatattgtttttgaaaatgtatgaatacagatagaaatcaatggactggagtatatgcatttgtctatcttggattgatctagtgtattgagtcacaaaatttagttgatagaagggatagagtatgagaaacagagtcccacaactttgcatcaacttagaaaattattcttttatttaacattcattcattcattcatttattcaacatttttaagtttccgttccaggatcttgagtacagacatatgtggttttattgcactttgctttatcatgctttgcagatattgtgttttttacaaattgaagatttttgacaatcctatgtcaagcaagtctattggtgccattgttccaacagaatgtgctcactttttgtcacattttggtaattctgaaatatttcaaaagttattattaatctgttatggtgatctgtggtctttgatgttaatattgtaattgtttgggagcacaacaaaccatgcccatgtaggttgcaaacttagttggtaaatgttgtgtgtaatagttgctacaccaaccagctgttccccaatcactctccctctccttaggcctccctattccttgagacaaaataatactgaaattaggcaaattcacaaccctataatggcttctaactgttcaagtgtaaggaagagtcacacatctttcactttaaaccaaaacctagaaaggattgagcttaataaagaaggcatgtcaaaagctgagataggccaatagctaggcctcttgttccagttagccaagttgtgaatgcaaaggaaaagtccttgaagaaaactagaactactttagcgaatacacaaatgataagatagtgtgacattctaattgctgatatggagaaagttttagtagtctggataggagatcagccacaacattctcttaagccaaagctaactctcttcaattctatgaaagcttagaggtgaggaagctgcagaagaaaagttggaacctggcagaggttggttcatgaggtttaaggaaagaagccatcctcatagcataaaagtgcaaggtggtgcagcaaatactgatgtagaagctgcagcaagttatccagaagatctagctaagattattgatgaaggtggctacactaaacaagagattttcagtgttgacaaaagggttttcttttggaagaagatgccatcttggctttgaatagctggagagaataaggaaatgactgacttcaagggacaggctatcttgttaggggctaatgcagcaggtgaccttaagtcgaagcccatgctcatttaccattctgaaaatcttagggcccttaagaattatattaaatctatcctgcctgtgctttataaatagaacaactaagcctggatgccagcacatctgtttatagcatgatttactgaagattttaagtccactgttgagacttactgctcaaaaactaaaaaaaaaaaaaaaaaaaaaaaaaatactcttttaaaaatattactgctcattgacaatacacctggtcactcaagagctctgatggagatgtacaagaaggtgaacgttgttttcatgcctactaacacaacatccattctgtagctcctggaccaaggagcaatttcaacgtctaagtcttgttattgaagaaacacattttttaaggtgatagctgccatagatagtgattcctctggtgtatgtggacaaagttcattgaaaagcttctggagaggattcatcattgtagatgccgttaagaacactcatgattcaagggaggaggtcaaaatattaacatttacaggagttttgaagaagttgattccggtcctcacagatgactttgaggagttcaagacttcagtggagaaagtatttgcaggtgtgatggaaatagcaagaaaattagaattagatgtgatgcctgtggatgtgactggattgttgcaatctcatgctaaaacttgaatgattgaggaattgtttcttacagatgagcaaaataagttttcttgagatggaatctgctcctgatgaagatcctgtgaacattattgaaatgacaacaaaggatttagaacattacataaactgggtagataaagcagcaacagggtttgaaaggattgcctccaatttctcaagaaattttattgtgggtagcatgctatcaaagagcattatatgccacagagaaatattttataaaaggaagagttaaagcagcaaatttcattgttgtctttaaaaaaacaattagcacagccatctcagacttcagcaaccaccatcctgatcagtcagcagccatcaacatcaagggaagaccctccaccagcaaaaagattatgactttctgaagattcagatgatcattagcatttttagcaataatgtatttacaaattaaggtatgtacatttttcagatatgttattgcacacttaatagactacagtatagtacaacttttgtatgcactgggaaaccaaaaaattyaggtgacttgctttattatgatgttcactttattattcagttcactagaactgaacctgtaatatccctaaggtatgcctatgcttgaaaaatgttatcagtaagatgtgtaatgtgtgacaaatccagataatacattacttttggagaagctgagctgtttcaaaagtgttccttttatttgaagaagaagcagagtagcccaatcaagtaattttatttattttgaacttacacaataatttacgcttttgtttttcagcaagtagtaagggaggtgggttaatctgaaatgaaatgttcttagatcctgytgttcagttggttggagggcattaaagatagttattacttaagatctctgttgttttgaaattcccattttcctctgacctaaattctatgatgtaaaagaatcccagccaccacagatagactgtttttccttatttaaatgctttaaaatttagttttgacggaatggtctcttaatagaattcttgtgattctgtaacatcttagcatctttggttggcacttagaatattctcccacaggcatatttcatttgcctgtatgcttgtattcctcattagcttatttcctctggagagtgagactctgtttctgcatgtaacagttgatcagtaaatgttttgattattactatttagatcctgaacatgaacgggctcctattcctttcctattgctgcccccaatgaatttttacattcaaaaagtaatgacgtgttatcttggtttttgtttctgggaaatattaggaatgctttttggcaaatttcaagggaatcctatttggcattagaaattatttattttgaggcctcgtgtaaaataagcttcaggattttgaataactttgggccctggagagagtaatacctaatgaaaactgcaactcaaagaaataatgaaaggcctctttaggaatcaaggtggtagctctagctcttgaagtcttctaatcaaagagtcaacaaccatttttgatctctgatcgccaaagcaggcctcagaggggtcaactggccatgcagcctgatctcagagtaatggctcctcctatttcaagattcaactcaagcatcaattcctgtaagaaaccttgacagaactgccttttctcccacctccaagtcaatgtgaccactccctttttgccttcactttctctcctgacttgcatttgatcagctaaatttatgtaaaaaaatgaagcctacaaccctaagctgatctgaaacacacagcaaatggaggtagccacatatatatttgataatttcccagtttatagcataacagttaaatcattgtaatttcttatggaatgtatggatcaaacattacatttattctgtattgtgtgcatttggagtaatccatttgacatttttttttacattgtgctagaaaagttaatgaggccactgaagagaaccaaaagtaggaattagaactgaagatacagcaagaattgctaaaagaaaggaaatactgtataaaagagaaaaaagacttttatggagtgattttagagtaactatggctttgtaaaaatgcacatcagtttatcagttttataagccaatgcttggtgggtatggagtttttcagtgatccagtttcaagtaaataagcaacgaataagaagaaattgtgtttctttctagaatgtgttgtcaaccactgaatttaatgctaccaatagatgcagactcatgaagtgcagtatgatttcgataaggcctaagcaattatcaaatcagaaatggatctctcatgctataaaattgtacatttaagcaaataattttaagataattggctttcaaactatttttggatgtatcagaagggatggttgtggaaataacagcacagtaaatgaatagttactggaggacaggaaagcagaaaaaaaatctgaagtgtaaggagatacagtcaagctgtttataaaatacatttagatacaaaagaggtcactgtgtggaaaacctttagaatcactgttgaaagaaaaaaaaatgtccacttcccaatttcaagttctattgggattgtttgtattataaagagttgactaataaattcctgccaaggattatttccctatccaaacaaaatgtccacaattctttatgagagaagatgatacccatagcttctgcttcccgcagtggcactctcatcacatatattggtaagtatagaggtgccaaggagaagcaggcaacagttttctccatagcatccatagtcatgctgttcagcagataagcctagtacagttagtatgtcctgattttttgctaaatcctgggaaaaatgaaaagagtcttccttatgcagttgtgttttgctgctgagttgtgtttgcagtgtattagaagaaatacatgtaggaagcctgttttcagtacaccactgtattactccatggtcttgaatttctgaggtcttaaaatagggttattaatattacggagaaagtcacactgctgggtaatctgrttgaaatggagacagagcataaaccaatagaggtgtacacatatactaagaattttgactggttaagggaaacaagaaacaaatgtatttgttttcattagtaaatatgattttttctcaggatatgagtaagaattagtgaagagggaacaatattaaattattttccttagtaaggtaggatattaaaaattaatcccttctatttgtcagttttccatgtccagagttaattgaacagttgtgttaacattaatataacattgcttgctggctaccaacaataatagcatggaagaatgttttaaggtatgtcttctggtagaataactatatcctcattattaacagtgtggaaaatgtagaaatgtagaaggaagcaaataatcactcatccagagatgatccatgttaatgttttagtgtatttttttctatatttgtagctttgccaatttcacacagttactttttaatatatacaccggggttaagtctttgtatgattacaaaataaattcttgttcaatttttgagaaaaataaggaaactatgaaaacagtataaagaagagcatgtgtgattcctagaaaacagcaaaaataatttggaactgcttttaatgacaagggtaggcaatcaagtttgctaaaatgaataggataatcagctccagccataaataaattagtatctttttaatgtgtctgttgtgtgtattctgcagctggctcttaagtaatttttaaaggaggcctgatatgtgttcggagggggagcaacatgattagaatatggtagctagcttggaataggcatcatcaatgattcgaatgcatgctctagatcatgcatgctttggaagctacaaagcttctccaaatcttggagaagcaacacagtgagaaacctgtcactaagcttttgaggattcctatctggaagaggactgttaacagtaaactcaggctgcagttgattttctttccatcatcaacatattatctgggtctagtgaattacaaaccctcctcttggcttaacattctctctgatggctttctgcacattggcttcctcttcttgctatcacggtaattactcaggagacataccataggttttcttgggtttagatcagcttaggaaagaaaagaaaacttaatcagtgaacagatttctttggcattttccatgtaatcctgggacccctgcttgttagttttgtcctgtttcctgttacagaaaaggctgaaaatcagcatgcagatgaatgagatagcagatggttttcccgtgatagagaccaacaatttgtgagatagaatagtaacgacaaacatacataagagaaaaggcagaattagagtacagtattttaaaagctttcaggcgctcaataaatgctcactattgttaaagagagagaaaaaaggaagtcctgtataatacatcaataagattttaattttcagttattattatttgagctttatttcccagctctctgacacagatttaggggtggtgtggatattcttagagtggaaattattgaactcttagattaaaggtactcgagttcctagcttgccctgtaactacacatatagagaagatcactctcgtaggtgctagtaagtaggagataaaagttttagggggaaacacagagggatactcagaactgggagcagtcctaaggtggaccttcaaaatgattcatgtcttagaaaatatgatttaagagaagttaggtctatagggtcattttatctgaggaaagatggctgtaaggatctttaatgataggagtcaaatatatgagagattgttgcaaggagaatgttaaccagctattctacaactcgactggggatagaaatagctttaaattacaatatacagaatttagattagataaaggaagtatgctctgaaagtaagagttgttaaaagttagaatatgttttccaagtaggttacaaaattgttttaataaaattatttgtgtttattcaaaaataatgaaaacatatatattacatatataaatattgatatattacatatcaatatataaacctaggatataaacccaatatgtaattgatatgttacatatcaatatatattatacatgtattgatgtcttacatatcaatattatacatgtgttgatatattacatatcaatatattatacatgtgtttattatatgtgtgtgtgtctatgtacaaaaagatagctttttgacctcaacagcattataacttgataattgtcttattttggaactcacgctgaagtagctttcagatactgttctagaaggcttaaattaagtatgttgacaataccccaaactactggatgatatttgtaatgaatttcaccctatatcagtacagaagggtgtcacagttcagcaaaacaaaagagaatacgctttgttaaacctctactttctgaattttaggacagtgaggaaatttaacattttcaatttttttttcttttcttgactgaaaagaaagtcaagccagcaatatgtttctgagagagcagtgatgcatttcacaacactgttaactgtctgcttggctttttgaggcttccagagttcagaattgtcttctcttgaataggtcagtgcatttttttccttcagtttttctccttaagcagcaaaacagaccatttaacttccaaatatttacagcttgcaaacagataaacttcccaaatctgtttttttttatgaaaaggaaaacgatcagccacaataatctataatacgatatatttgaatcaaagttattagatgccctagggtcttttcatggcagattttatatatcaccaccattaataaatctgttatcagaattatgtctttctctctgttgatagttatttttagactaacatattcatacctccttctgatgaaaaacattaaaatttgaataaggcatattagaaaaccctaaagctctgtatttacacaaaggagactcataaatattggtttttcagggtgaagcattgtgtgttattccattttgtaccacagggaaagcctagtcacacatggggcctcattaaaagaggatctaaagaaatatttaatggttgaaatataaggtcttattctgaatatctaccttcactttataataatagaaactgaactgaaaagattcagtaagtgatttagaacatccactcattttaaaagtaatgtctaggcctaggaaagtgacatcatgttccaaatgttacaaatccagcgtttttccttgatgtctttataaatacattgtttacagtttttattctcctccatatatgatgccccttttctaagattatttcgtaggtatatcctttaatgagagaacctcataaataaacttcctgaatttgaaaacgagtgagaggagacttcaagtttgtggactgagctaaacatgtgtctactctcccttcaaacatcccatggaaatggcagtaaagacagaacaaagagaatacatttctgaatatactgaggaacatatactccagagagcagaaacaggaagaggggcctctgctaaagctgaaggagtcttcaggagggaacccagctgggctctgtgttctggttggcagatacagagagtagccaaggtcaaaagcagacaaacagaaagtkaggtgattggccacaggtttggaaatggctcaggtttgctctttccaaccccttgcatgtcactgcacatttacctccagaagtaaagcaggagaactctgcaaagggaaccaacamtctgcatgggagggcattgcctccaagtgtgtgggctggcgaccaagtgcagccctctgccctagttatgggagttggagagggacttactggtttgcatgttccatgcaagagctaaagcaaagcacatctcggagaagtgagccaggaaagtggatcaatccatgccaacaacctatattaattaacctgataattaatatgtatataaagtgaaaaaaaagaaagaaaaaagggaaacagccatgagacaggatttcacaacctctgcactatcaacattttgggcaagatactcttttgttctggagaagtgttctgtacattgcaggatgttaagtagcatgcctggtctctatccaattgatgtcagaagcaagcaacatccatccctggccactgtgaacaaaaatgtctcaatatctagacaaagatattgcagcatactctggaggacaaaaccagcactagctaagaaccattatcctagagaaaatagaaatggtttagagaagagatcttttcaagatatctaccttggtatcctcagacatactgaagaattacagtctctaaaataattttctgatacggaaaatgaagaaatcaaaggacagaaataacccacggaattttaaagtttaattaacaaaattgttgaaaaattcaaggaaaccttccaaaaggaaaagaaagaagaagttataatatgtgaaaaaggggaagagacaaagagaatccgtttaggaagctaagtgtctgtctaataggaattctaaaaccagagggaaaaagcacaataaatgagacaaaataatcatgacatttcctagagttaaagaaaggcacgtcctcagaatgaaaggcccaaataatgttgagaacaatgaattttaaaatacctacatcagacacatgctaatgaaactttagaataccaagacttaagatcctaaagattttgaaaaagaaaaacataaacaaacattctatcataggaatgacaatcacagtcaagttttcaatctgcatcttgaaaatgccagatgataacaggacagtgacctaatgttcggacagaaaacaaacctaataccaaatggaatcaaacaggaaactcagaaatagacacgttaatatgctcaagtgatttttgacagaggtacaaaagtcattcaattgccttttccacaaatggtgctggatgcccaatggcagaaaaaagtaagtcttcacctaagtcttacaccttacacaaaagtcaactgaaaatggatcacagacttaaatataaaatatgtacctataaaaccttttagaaaaaaacaggagagtgtctttcagatctaaggtgagccaaataatgggtcgacttgatactgagatcacaacttataaatggaaatgttgataatttggactttgtaaaattaaaaacctttgccctgcaaaagaccctttaaaaggatggaaagacaagctacagattgggagaaaatrtttacaaaccaaatacttgatctaggactagtaactcaaaagtcaacagtaaaaaattttagtaacaatctattttagaaaatgaacaaaagacacaaagagatatttcaccaaagaggatatacatttggtgaaaaagcacatgaaaagatgttcaaggtcattaaccattaagaaaatgcaaattaaaactacaatgaggtatcactatccaactatcaaaatggctaaaataaaaagattagtgacgagaccaatcgctggcaaagatgcggagaaactggattactcattcattgctgctgggaatgtaaaatagtacagcccatactagraaagagttcaatttcataaattaaacatacaactaccatatgacccagcaattgcattcctaggcttttctcatagagaagtgaaaacttgtgttcacatagaaacctgtacgctaatgttgaatgttcacagcaactttatttgtaatagctgcaaactggaaacatctccagtgtccactaatgggtgcatggttaaacacattgtgatacatccataccatggaatagtattcagcaataaaatagaacaggcatgcaatggaaagttacatgcaacagcctggatgaatttccagagaaatatgctgagtgagaaaggccaatctcaaaaaattacataatgtatgatctaatttttataccactttgaaacmataaaattaaatgaagaacagattagtggttgccaggggttaagtaaagtgggaggaaagtggttgtggctataaaagtgccacatgaggaatgcttgtaatgatggaattgtctgtttcttgactatgagtgtcaatatcctgaatgtgatattgtgagatgttaccatgggggcaactgggtaaagggcaaatggaatttgtcttatttcttacaactgcctatgaatttacactgatctctaatgaaaagtctcatttaaaaatttgatagtgcttgattttatcagttgatcaagctgctcttagttgaaataacaatttcagaaggatcagcataatgaatctaccagtcactgaaaactctcaattatctgtcttgtcttccctttcagtttttgtttcatttctgttttagtaacctcttagaaaaaggtagtattaaaggagacctaggtctcttttaccaatttaggataacttcacaatctccgcagataaattggtatstgtgtacacacacaaaaataggaaattcttgtgagtagtttacaggggaagtgcttaatatataaacaaggcagtgctctggtaaaattacttattgcattgagattaagaacataataaaattattaaaatagcctaccactttcattacagacttaaaatgttcttccttttatctctgggggttkgataatccctgtttattgttcttttattttgctgtatatcacgttggccatttaatcattggctctttagcagggtgggtgtagagagcattaaaaaataataaatgatgcagtttatcatcacctccctgtaaaacacaaggcacgtgaaggatatgagtttcctttaagctaacgtatttacttaatgtgatttcaaacaaactcctacaaaagtttttggttatggcatccattttggaatttgaaaaatatatataattcatctgaaataaatgtataaaacagctaattttctggtaagatataatatgtgggattatcactactacttttcaaaatgtagtctaaagaatattacttaaatgagctttatgctgagtaaagaatatgggggaaaaaaccctaagagtataaaagcccagaaagagcctcttctacgtatgagagtgtatgtatgatatactatattaatatatgtattgtttaatataacctattttgataaataatagtataatagactatattatatactattatataatatagggaggaaagtaccattaaataaaagatactggagcaactggataactatttgaaaaacaataaacttagaccatttgttgcactatacaccaaaataaatttcatatagattttaaggttaagtgggaacaaaaagatatcacacacaaaaaactgtatctgaaagtaaatatgttctccttatagtagagtgaaggaaatcagttaaagcattcaaataaagagaaaaatgtaaagagaaacattagtatatttgctatataaatggtaaacgttttatatgtcaaaaatcatttgtatattaaatatttatattaatctgtcatatgtggtagatgattaatatacctagcatataacatgctcatataaataataaaaaaatcataasagaaaacaagacaaaagccrtatatgtagataattcatcaaatggaaaattataaataagcaaattttgaaggaaaataaaataatatgttctatgattaaagtggtcaatgtcttttaaaggctaatattaatagctgacttgtggtctgtaaagaatagtttatttaacatgtgacttataaaaatatataacacttttggacagcatttttagagataaatattccacactttttgtagcattgattaactttattcacatcttaaatacttataaaaatctgaatactactttatttcaatgttatttaaattggtgtcaagttctggctaatctacctaccgaatagtaagaatattgttatgcagatcattgttattctataaaatgcagtaccattcagtcattcaaaaatacatttccaaaaaatgtttagagaaaatgctaaaattatgctaagtgaaaattcagacaatatttaaaattttaatagtctgacagattctgatatagataaacagaaagaaagaaaggtaatgtaattttcatgtaattgtacccawgtatatggggaaaaaaggcttgaaggcagtatacaacaaaatgttaaggacttgttatttgcatctactatttcaagaattccttctgaatataaccaacagtttatgcacaaagaatttaattgcaatattcttaataacggtgaaagtcaaatattcatcaataggtaagtgtttaaattacattatcaaatactcrgatgatakaattctatgcaggcattataattatgtctttgaagtgtttctgttttaataatatgtaaaagtgcttatgatataatgctaagtaattaaaccatatgaatgtatgttaaaaggctgcatgaaaatatggtaaattgtttgcataggttatcattgagtagtgaaatcataattgctatttctttcttttttctttttttttttttttgagatggagtctcgctctgtcgcccaggctggagtgcagtggtgcgatcttggctcactgcgagctccgcctccygggttcacgccattctcctgcctcagcctcctgagtagctgggactacaggtgcccaccaccacgcccggctaattttttgtatttttagtagagacggagtttcactgtgttagccgggatggtctcgatctcctgacctcgtgatccgcctgcctaagcctgccaaagtgctgggattacaggcgtgagccaccgcacccggcccataattactatttctttcattatgttctggacactccaaattttcaactacagggtccagcctttgcaatcaggaaaaaaaaagtgtttaaaaacatctctgaggacttacatataacaccagaaggatttatacatttatttagttaatgtggttaataaaaccaaaatattctttaaaccatgtcttagcttcattcttgtctgcaatactttggcactgcctggatttggcatcatgaactgctgcaactaaaataacagtaaggtgcatttatacaaaggaagaaatgagagattaaggtcccctgttaatactaaggagcctgatagattttgatatgttttgtgcactggtatctgtattttcattttattgatttttttctaaggaccttacagctaaagccaggtccccaaagaagtcaggggtttttgtgttacccacaacttggcagaatgtctgcaattactccttctgcttttaactgactttgaatcctctccttttggcttgagtacctggctttcagccaggagaagggaaaatactctatctgttggttttcaaatgtcatttcccctttggctttgttgatggtaaaattctgcctttgcatctgaaattggaaactcttctaatcctggagtctgagtgtaattaatcggaaggctttctcttatctgtgtctaggatcagcctttagtctgatcttcatttttatccaggtgcaaaactcaaatacttttacctttagtgcagtggcccaaattttgtccctagttctgcytgtgctatcattaactgtcattttttaattatatctacacacgaatgtgggccagaggcagcaagatctggattttctcttcctctctgagtccctgacccttggattgttcttccttcttttcaattttggtgggttctgggtttagatttgtagcctaacctagtcaacaacttctttggcatagaaaagaattatttctgatgtgtatattttcccagaagttagaatacccctttgatatatttatttgtgtttaatccacagaaagaatgaagaattaagttatattaacaagagtatcttgcagtatatatatgctttaaagttcacagtgactttgacatgcctctttcatttagttwtcacaactcttggaacgtgtttttgcccattttctgcataagaaaactgaatttcagtaaaattaaattgtttttcccaggcaacccagccaggaatcactagtccccctctctcaaaatccagcatttgctcactagaccagagctgctttaaatgacaatagtgtatggaattcattatagtagaatccattctaaacacattgttaatggtttgatcaaacatctttagtagcaccttttcattcatgttttattatgtatgtgtgctacccactttctgtgcagaaatttcaaggaaaaggaaattaggctttctgtaatactcctaatccctgtccttaataagtccaaactctttaacatgatacataagactttcactatccggggaccccagggtactgcaccattctcatccatgtttctcacctctaagcttgtgatactcctgtcatgcagcattttcctttgttgtccaaacgtgtcctgctttaaatgttaccattctcaattctcatctgcctggtgaccttgtgtttcagtggttgtctggagcgttagtgttcattagaataacctggagggtttgttaagacatagcttcttggacgcccacttccaggtttctgattcagttgatctgggccctgaagttgcctttctaacaagtttccatgtggtcctcttgctgctggtctggcatcacactttaagaagtattattctacttatccttcaagacctcaacctaattgatctacagatccttttccaactataggaatatttaattgcttgttactctatgctttcaagctcttgtttgtgtaacatctcacattttttggtgactatttatgagtgtcttctttgcttaactgtcttccttttacaagggaaaagacttgtttgacttgtgtttagatcctcatgggctaacatgatgggaactcatgaagaatttgtatgaataaataatgaacctggaaacctttgttcatttaaagttgcttgtacaggatgaatgttttgcttcattggtttccattattattgtcttcgttcccattcaaattctgtttctaggcaaactggaagaggaaaactatgtaaactgaaaatacaattctaagcctcccaaccatctgagtggaccccttctctcaaccaagggcattccaaagttaacctgaaaaactagttcaggccatgataggatgggggagtaggacatgcctcaatattccctcctcccttctggaactcaggcacagctgaccagtattaacattaaaatagattttaagactgacaaggcagactgtttatagcaataagataccacattccagcctgaatctagtatagtatcacctgacagatagcagaccctgaaagaaatcaaagtattttatctcaaattatggttttttgccatatcttggaatagtcctgcaaatctgtctctcatgaggaaaatccacattctgaagagaatccctttccttttccaggcctctttcctgatccagaagaaaatcaactctgataagaaacatttacaatctattctctctgaagcctgctacctggaggcttcttctgcataatgggaaccctggtttccacaaccccttatcttgacccagacattcccttctattcattctaggtctttagactataacttgactctttcatccaattagaaaatctttgaagctgtccgggcatagtggctcatgcctgtaatcccagcactttgggaggctgaggcgggcagatcacccgaggtcaggagttcgagacaagcctggccaacatgttgaaaccctatttctactaaaaatacaaaaaaaaaatgagctaggcgtggtggtgggtgcctgtaatctcagctactttgaaggctaaggcagaatcacttgaaccccggagacagaggttgcaatgagccgagatcgcaccattgcactccagcctgggtgacaagagtgaaattctatctcaaaaaaaaaaaaaaaaaagagagagaaggaaagaaaatcttagaagcccctcacaccttgccacttcaaattgtccccccttttcaaatcaaaccaatatacatcttacatatattgattgatgtcttatatctccctaaaatgtgtaaaaccaagttgtaacccaaccatgtaaggcacatgttcttaagatctcttgagggatgtgtctcaggctactggtcattcacatttggctcagtctaaatctcttcaaatattaagagtttgactctttgacaactaatacatatatattttaataaccactatgtgccaggaactgtgcttcatatatattattgtgtaattctcaragtaattcccatgacataactatagtacatctgttttaaagatagagaaactgaggctcaaaaagactaagtattttgtaaatattctaagactggaaataatatttgatttcaagattttcttattccaaaatgtgttctgatctgctgctctaccccatctctactaaaaatacaaaaattagctgggtgcagtggtgcacacctgtaatcccagctacttgggatactgaggtaggagaatcacttgaattcaggaggcagaggttgcagtgagctgagattgcaccactgccctccagcctgggtgacagagcaaaaatctgtctcaaaaataaataaatacgtaaatataaaattaaattaactcttgcttgtctcatgacaggtaaagatgatgggacagtggctgcctatcttcagataaaataaaggtaatctccacattaacattactagcagtggttcctgctctcttctttcttttttttctttgcatccagattcaattcctaaattactcccagtatgacagtgatttctactgtgtttctccttcactctctgcagatcattgaagaggtagctgcaaatgcctttcacttgcatggcttttccaaaatgtattcagattggctgaatttctgaatcaaatacaatttattttctctcttatcctagcagaagatttaagcaaagagatatgtaaaatatattaaaaaatttttaagtttccttttttttttttgaggcagggtcttgctctgtctcccaggctggactgcagtgatgtgaacatagctcactgcagcctcaacctcctgggctcaagtgatcctcctgccttggcctcccaaagtgctgggactacaggtgtgaatcactgtgcccagcttatttattctttctttttttttgtacccattaactatcctacctctctttgtcccaactgcccttttcagcctcttgtaaccatccttctattccctattctcatgagttcaatcattttgatgtttagatcaatatgggacttatatttttaagcattttgatttaattttcatcckttggccaagcttggtgttctgcatttgcaaattttgttagggtacagggtagtcatggctgcaatctggagaaaataatattcaagatagtgttccaggacttattattatcatttcttactggtccattggctgagttggaataccagctaatttattagatataccctatgcttccattgtgcaaacctcagcctatacttggctacattctcttgtaaacattttcaagctttttaaaaaaattccaaggttaaatttgagttgtagaaaagaaatatgaataatggccatcataattattccattataaaaacacatacacacactcaataaaatgtgttgttttaaaattattaccctaaggcaagtggtgaatagatccaataaaaataaaagaaatagaatgaataagaagataataagacgaatggaagactacattctttctactgactggtcatcggtttttctaaatcttggtcctttatctccaatgggtctttgaggacaagcacatcttatgtactttgtaaatatttgctgtttatgcacattttgagtatcattgtttagctttgcttttcagatgcatgaaacaagtamatttgaggcagcaaatgagtaatttgtaaatctagacacaatgagaaggcaattaagaatgctgcttgatgaaaaagaataagagaataatgttgtaggtaagggacaaactaatttcactaatagtggctttatatacagtccagtatgtgaaaatacttaagtaattaacattaacattcacactgtcatcctaggtagtgataagatactggcgaccacacacaaaaatggaatagatatctgtgtctgtaaaactaaaaactcttcaagggagaaaaagctctagtgaaaaatggaattcaccaggaagtcactcaagagaatgcaagtattaaaagcactttattataagataaggatgtcccattcttaaaataatctcctagggaaggcttcaaggatagcattatactaagtagagaagttgtctgacaaataggtaagtataaaaatcagagaacctacagaaaacaaatcattctttgagttgcatgaactttaggaaagagtctttatcagccatgatcaaataaattggacaggtcatataacaagttagaagttgccaaaatttttttatagaagaaacagatgtcatcttcttttgtaaactacatcctgaacatatcccatcctgactgcttcgtggcgtatataaactcccactccacccccttttccccgtctcaagcaagctgacctaccaagctgtgtatttttaatcactttctatagcaatcaagaatttgccatcagagaaactgcttcactgcgtcttatctttccatgcctgttcttgctaaacagatttaagataagagcaactggcagtaagtgcccttcctgaaaacagaggtcacagatgtttctactgaagcccagtaaatggttttgggagacatttgaaatcttagtcatattcaaatcccaaatacaatttctcttttttttcccagaaatttcaaaggttttagaaatattttctactggaaaggtatctctcattcttactcaaaatttagacactaatgagtagatggcaagtcttgtttataagcattaatcrtgaagatgaacatttataactgaaaaaagatgttcgaattttggggtttgtaaaagaactaggaatggagaacatttagagttcactatgtggtgatattcacaaaagcaaatgatgatataactatgtcacttggaaggagcttcaggcaggttctttctcttctacatgtaacatgtaagcctgttttggggtcattgctgaggaaaactacttcttaagacaattttacgactgcattgtttcaatagtacaccaaactatgttggaaagttatgacctagaatctgaaaaagaaaaaagtgatgaaggaataatgaaaggctgcatgacagaagtatttagtcttcattcctgtgtttgaagcagaaaaaaaggtattgagggctaaccagactctgccttttgctaaattgaagagtatcacatcaaaggccaaagatccattttaacaggtgccttaaaaagttgtactaaatgatctctgtgcccctttggatcatgaattgtctacataactgcacaacgaatgaacgtaagaaaaatgaattggctggtgaagcctgtctggtaaacaatccatgatcctgagggaattgtagttttgcaaaatattcagcaactactttagtttaaatattttatatgactcattgaagctccaggaagatactactttcttctcaatatcagttcctggttattgtcatcattcctttatcagagtttgtttccttgtcaaatgaactcttaatacatgtatctatcactgacaattttgtagaaaggtcattatctgttctgtttcccactccatgaaacggaacttattccattcaacttcgtgtaaagtcttttcaaatgacacaactgtaattaggaaagatgtcaataactatttacagatatttatgttgtattcagaactgtactagttagagtgtgtggtttaaaaatttaaaaaaaaagtgggtgagatggtgagacttaactaccctattmcaccactactaggatggtaagaatttagtaagtaaaccagaaagttattagaaaaacaagtaggagcaaaataagctctgtggcattgaactaagaataaaatgtgaagagaaggggtgagctctattatctacttagggatgccttcagtagaaaatgggacttaaaaatgggcaaaacttaggagggtctttccaggaatgagaatgaacagatcctgggataagttaataaggttggatttattaatcacctgagattctcttttttgattattgggtcatcttgtacacatcaactctgattacaaagtaattagtaatcaataattatttctgcatgtgccactggataaccattcaatacgtaaaaatatttaggtgaaaactttgcttgccaaagtttcaaaagttaaatacttaccaggctattatcactatagaaaacaaaggatgagacgttactatgaaaaggatgggtacaaaagtcatttgaagaagaaacgtactaataaaaatatatttcttaagtactttagtctgcaagtggcataattatttgtgtgcaatatccagaaatacatgcttcttggtgggttttaacagacatatttttacaattaaaaagtatatgcctaatttatgttgtggcagattacatttttcaaagacagttacactgataaatcccaacccacatggccatgttataggtgatgttgacactcctccattgggaggtatggaccagttttagtgactcactttcgtccaatagaacgtaacaggaataatgctacagtccaggtcataaaagggagtagaacttctaccttgttctccctctcatgatgttagaccttggaacacagccacatattgtgagaaagcccaaactaccccatgtagagaaatcacatggaaaggcccacagagagaggaactggggatccagctgatatttagcatcaattgcaaaatgtgagtgaaggaggcttcagatgattctggcctagagccttcaacttttttttttttttttttgagatggaatctcactctgttgcccaggctgaagtgcagtggcgcaatctcggctcactgcaagctctgcctcccgggttcacgccattctcctgcctcagcctcccgagtagctgggactacaggcgtccactaccatgcctggctattttttttgtatttttagtagagacgggatttcattgtgttagccaggttggtcttgatctcctgacctcgtgatcctcctgcctcggcctcccaaagtgttgggattacagacgtgagccaccgcgcccggccgagccttcaacttgattcttccatgagaggccctaaacatcatggcaaagagtctaaccatctccattgtgctctgtctcagttcctgacccacagaatctactagcatagcacctctaagttattgagtaatttttagatagacaataacaagataatatgtcaatctggttttcatatctaaatttatactggctccagatattcacttaagattttatcttggccaggcatggtggatcacgcgtgtaatcccagcccttcgggaggccgaggtgggcagatcacttgaggtcaggagttcaagaccagcctgaccaacatagggaaaccccgtttctactaaaaatacaaaaattagccaggcgtggtgatgtgcgcctgtaatcccagctacttgggaggctgagggaggaggatcatttgaaccctgcagaggatgtggtgagttgagatcacaccactgcactccagcctgggtgacaagaatgaaactctgtctcaaaacaaaaaaaaatttctctctaatatacaaataatatcactttcaaaaatgtatctgctcttctaaaaactcagtttccaaatagtgggctagtcattttgccaaattttagaaaacagttttaaaaaatcacacgtagctccaaatgtggtgcactttccttggttttgttcagtgctcaatacattgatgttgctaaaggccatatcagtgccctccgaccatggaagtttggccataactagttcaagccctgaagaactgaccctgggagtcaatccatatgctgctttgtcccaccaagaagaatctctcttctaagattttgaactaagagattgagagttagagagtagctatcgctgaagctgtcaagatcatctagacttgtaccatctcatgccagtcagatgactgttattaaaaagtcaaaaaataacagatgctggtgaggctacagataaaagagcatacaaattcactgctgcttggaatgtaaattacctcagctactgtggaaagcagttagtcagtttctcaaagaacatttgacctggcaatcctattattaggtatatacccaaaggagtataaatcattctaccataaagacacacgcatgcatatgttcatcgcagcagtgttcacaatagcaaagacatggaatcaacctaaatgctcaccaacagtagactggataaaggaaatgcggtacatatacatcatcaaatactatgcagtcattaaaaagaacaagatcatgcccagtgcaggaacatgtaaggaactggaggccattattctaagcaaactaacactgaaacagaaaaccaaatgctgaatgttcccacttataagttggaggtaaacactgagtacacctggatacaagggaacagtagacactgaggcctactggagggtgggaggaaggtgaggatcaaaaaactacctatcaaatactatgcttatcaactgggtgatgaaataatctgtacaccaaacccccataacatggaatttacctatataacaaacctgcacatgtatccctgaacccaaaataaagtttttttwaaaaaaaataagatcatctagacttgggtaggtggccattgtggacatcatacaagcagaagaagctgatctatggagaagacccataggacagtagtattgagaaagcatagagtcccagagagagacaatccagtttccacagccttgactaatattattgctttataattctgtaaaatttcctctgaagccttccagtaagctccttttccacaaacaagcctgtttgactagcttcttaatattaaaaccaaataatttctcaggtggcaataagggggaagtggagtgcattggtcacacaaaagacaacaacatgaaaatcttaattgttttcagtgtcaaacacttgagtttctggagacaaaactccctcttctaagaaaatcaaactattatacatgataattgtcactttgttagttaagacacatttatacaacattttaagatttggagggtagatactttattaataggtggtatggttctgttcttaagttatgtttctgatttttagatagatcattccctgtttctgtttgtgggaaaaatggctgtctcagtaggctgcattataaactcagttggaaaaaactggtttatttgttgaatgagaacttcatttattttgtgtaaatgagcaccactttttattattcacaggttattgacaagcataatattaagttaagatgcttgacattaaaggattaacatgtacaaatttgaaaaacaacagccgcctagtagacactcagaatttctgttcattgatcaactaagcataatatctctgctctttagcaagtggtttaaaaaattgatggttattagtagtataaatcttggaaaatttgcagagaaaatataatttgtctattctaagtatgttaaatggtttaaatgatatgttaaatagtttaaatgatgaatagcgtgaacaatattagctatactgtattagccattagccttgtaacaaattactcccaaacttaccagcttaaaataacaagcatttattaactcagtttctatgggtcaggaatccaacaacagcttcatggaatgaccccaactcaaggtctcccatgtgactgtcatctagctgttggccaaagctgccattttaaagacatgaatgaaacaggattatccacttccaagctcactgtgtggctgttgtcaggaagctttagctccttaccacgtgggattctccatgtggctatttacgacatggcttccctcagagcatgtgacacaaatgatcagagaaagatctaggtgcatggcctcatctcagaaatgaaaatccttcagttttattgtatcaacacaggtacgatgtaggagggacaatacagtgtgtggaagctggagatggagatccttgggagctgagttggaggctgctaccatagctatatctcttgctagagttcccgattttgcagcctgccatcacctcacctaagactgaacagaatcactgcctagatttacaatatcccagtatattctttttcatgtgcactctcactttacatctcaattttcattccgagcagtacttttaagaaagaattatcttcccctttaatgtgaggaaaaactcccctgtgtataaaaacaaaataatcattcaccatctctttctagtgtgtgacatgcagtgagatttaacttcattgctttgttagaatattctgttctctgtggagggccgtgtttttaaaaaatcactcttcagtttctgctgcaaaaataaaataaaattctctgtgaagtttgtcaagtgaaatggacacaaacatggctcaaagtctagaggaaataaaatgaagccacaatctcagtctatgaaaaagagataagttaggataaaactacagcaaaaaatgtacaggaaaagaatgctgctctttaggagagaaatcagaaaagtcagaagataaaatacagagcaaaaagtttactgatcccaacagagaaacaagaaacctcagagcacttatatgcaaagtatttgcrgtgttttggggcccactgactgtaagggaaaccaggtatacacagctttagggcacaatggagagaaagctcttgatatactctcctgagtctcataaacagcaacatcctccaacgtaaatgacagtgaaagaatatgatgaactcctgatgggtrgatgccacaggaggatccagccttatttttcctcagctctttcctcaaggaaaagactgggaattgataatactaaattgacaagtccaaataagccttcaggcaaagcagatgatccttttttttttttttttttaagtatccaaaccagtctcagatttcttcagccagaaagcatgtttttgcaggctttttacaaatcctaagcaaagttatgtagttctcgagagttatagaaaaccaggtttgcatcttggctctgatacccctccctgtgatactttagaaggcttacctggcctctaaaaacctccatcttctcatatgtaaaacacaaaaaaccctgacacatagtatgtgctttgtaaactgtagctcttgttaatagtgaataggttttgtttgtttgtttttcccaaaagaatttgatgcttgtgttttgaggagttaaaattctcaatgtaatagaagactctataataaacttacgtcttcttagggtgatacgaaaattattaaactcaatccccctttagttgcaaacaatcaatactcaataatttttttgaattgatgaacctctgattgtgtgcractatcttaattatgtctatattcttggtcttgtgatgaaaagtatccagaaaatgtctactattcatcactgtatgccttcttctttttagcacagagctttgtacatacgaagttctcaactaatgtctgttaatttaaattgaagaagctttagggagttactacaatttaggtctggaactcacatcccattttccttcttttgtcccacccctacccatttcagccatgcatatgtgtatttggagccctggatcttcaaaaaggcagcaaggagctaattaagccattaatgaattaactttattttttgaagtttataacttatttagacttagtgatctttctttgctcattaacacctctccctgtaggcagagagaaaaaagattaaaatgtgactctgtgaattcttaggcccatataaattcctaagtacaggggaaaagcatcgatttgtaagtcaacatgacattagtcagaagtgttggtttttctttatctgcaggatctgtttccaaacatatttgatacccaggacttgaaactacatcaattatttgaggaatcttgttagggctccatttgtatggagaggtaacactcactggtggcagtggtttgtgggtagaaggggccttcgggtatgtgcggcaaccttgtcaccagaagctgacaccaacaatacacactcacatttaaaaaatgccaaaattgtatccatcacctccaaaattttccttatgtgaaaggttttggcaaatccttgccagattttaaatgattcattctacatttgtatttcacagttataaagcagaactttgcacaacaagttaacttgccaaaatattatgtaaatattgccaaaatattatatcatcaaaatattgtataatatctgtgtattactttttgtattatatatttgtattacataatttgtgtatttatttgctgcttatttaatttataaacataacagaaatataagggaaaaaaagccagataaattttccagaatagatgagaaatggagaaatctgagtccttccttcaagttcattgattatgagttgagtaaccatgatatgctagtatcttttcaaatatataattttttgattatataaagataaggttgatcttcatctcagacaattttccagcctagtagaaacaataaacacagttggattgtaacccaaacttcaactgtaggtcatctcacctaagttagtggatatttggtataatgtttagtaaaaagytacactttgtggcccttcatcatagcaaatattggctttattggcctttaatatcccaaataagaattatcaagaaaataggctccattttcattattaagtatttcagagaaataaaacaataatactgccttaccattgtaggtcattttatagtttccaagggttttcaactatatctttttttaaaaatttgaactttataacatccctttacagagaagacattttacagaggaagacactgagcatcagggacattcagtgactgctggctggtaggcagcagaggtcttgaccagacccctggcttaatcttcagagttcttccatgctgatgcatggaagacttgcccaaggaagttgtctccatatgaaacagccttgaaaataagatgactttcagtctagtttgatcaacatttatgtaaacatgtaattaaaaattgtttgcttcaactcaacagtatgtctctgaatgggaactggttctttctcaggaatattcttggctgaatgtgtctgtgctgtgtcatatgcctcctctttacatatgactgtgggagggtgtggctgtttctataaacactgaaaacagacctgtggctaacaaaggattgtgggtggcagttgcttttagaaaccttggtgaaacttttcaaaagaatgtttcctatcaagcggtgcgttgtacatgtgggagaatccctgacagcacgttgctcttcctggagctccgtgagcatttattcccagtaatgtcctttggtgcttctttccttcatcccttaaygaacctaatccactctagccactcttcgtgatgtgaggtcaagagggtgaacayggcagatgtggcatttatgcgattacattctggtggaagaaaatgggccattaaaatgcaaaccaaaaatcaatgatctgattaattgcagattgtgataactgtaagaaagaaacagagtgccctgataaaaattaagtacgctgacttatttccatagggtttctgagaagatcttcactctggggaracaatatttaagctgcgagctaaaggatgacgatgacacataggaaagaatgttccaggctacaagaccaatcagaacagaagccatgaggcgggaagaagctacatgtctctaacttctagtcagtatgaccagagtgtagattgagacagacatgcagcatagaatggaatgagatgaaaatggagacagaggcgggatctagaatatgctatatcttgagtcttctaaaatgtgtccagcgtctgttctcagtgcaacaataaactatcaaagagttttaagcagggctatgagtttatctgacatctgttttaagaggtcattctattttatatgagtggaagagacatgaaaaagaccagttagaaggctaccagaacagtccagcagagagatgatgttgggagcaaataaagaattccactgtggaaatgtcacatttgagatgcccaagagacatctcagtagaagatttcaagcatccattgtatataaaaggctagagctcaaaggagaagtctgggtcagagatagatatttcagagttttgaacatatatgtgatacgtaaacaggaatacagattaagaataggggataggatcaaaccttgagaaattcgaatttttaagataagatatggaataaaaagataaaactgtgaaggaaagtcagcaatgtgaagggaagagcaagagtgtggagttgtcaaagagaagaggatctcttgagaagaaaggagtgtttgatttgaatgctgctgagaagtcaatacaaagaaggcaggttttacaacaggaccagcctcataattagtgcatctttcaaggagtgtgaagtactttcttcactgatttctgacattccgatttgtcttactttacttcattgcaccaggaggaatttgaagatccatccaagttgtcagccatgaaaacaaaagtgcagcacgtgagccccagctgtgctcctacctccttggtttggtttccatgagtagttaagcttagaaaaattgtgaagaaacttgttgtgtgggagcgatttttcaaagacctacaaacagaagtaccacttgacccagcaatcctaaacttgtatatatacccaaaagaatatgaatcattctatcataaagacaaatgcatgtgtatgtttattgcagcactattcagaacagcaaagatgtggaatcaatctaaatgctcaccaaccgtagactggataaagaaaatgtggtacatatacactactgaatactgtgcagctgtaaaaaagaacaggatcatctccttggcaggaacatggatggagctggaggccattgaccttaccaaactattgcaggaacagaaaactaaatacctcatgttctcacttataagtgggagcgaaatgatgagaccacatgggcacatagaggggagcaacagactctgggtcttaccagatggaggagggagagaatcaagcaaaataactaatgggtactaggcttaatacattgggtgacaaaataatctgtacaatgaaaccccatgacatgagtttacctaaacaacaaacctgcacatgtacctctgaacttaaaaaagaaactttttctgtatcttaggatcatgagaaagaatcacgttcaaagagtaacaaaattgatattatatttagacagggaatgggattgcaagtgaagaatctgtggaatctcttgatttgtgaagatttcttttagagttcagtaatggatctgtgacatccaatttttctagttaaagagaaagagcattgaactaagaatcagagacttggtttgcagtcccggattcattggttattggttgcttaaacttgggcatgtcacttaaccattctgacccctaatttccttatctgaaaatggtaaaaatcatacctacctgatagacttgttgtgagtgttaaaatgatgtggcttaaaacctagaggaggcattcaattaatgataccttatttttattaatattagcatattgggagtaagcacagggccaaatgcaatcatgtatagaaaagcattccgctaactataaaacattgaataaaatgcgctgatgtgtttatgattgataactgttttttgtcagctttttaattttagctgcaccatcttactttttggtacagatctatttactatctaggagttgtgggggacttggtgggtagccagaaaagatgacagctagcagagcttaggcacaggagcagatgtaagtgcaggtggctggcagtgtggggaccctggargcagctgctctcagggtaaaatccacgggaggactaggcagggtgagagagcatccccaggcaaagtagagtgacctgcctctgagagtttgggtgtagaatgcagcaggatgactcagaaaagtctgcagagctttagaaawgcttttttttttttttttttttttgatgtggtgtaaggttagaagactagaatgacgtttgtctattattcaggagatgttctttgtaggagaaagaaagggaaaaagaaaaagattccaaatattttagtgggcattatgtagttccgtctcttgctccttcccttaattccccctccagaggggaaacagatatctgtgaaactgaaaagcttgcatctttgtgagatctgctggagggaagctaccgtttaaacccagtctccattattttaaatggttttaagcctcacatgtagtgctatttatttttccttctaaaaaayatttctgggttatgcctccatatacaaaactcacctttgtgccattgtgctgttttgatgataggtaatttagctagatttagctaccatctattgagcacttaaaattaatctctgtaataaactctattcaggcatttcatcatttaatttaatacaaaccctgtagaaagtggatatcactcctcttttgctaattgggcactgaggtttaaagaggttaagttaatttctcagtttgctatagctagaatggaataggtccattatttcaatataggtttgccagactccaaagcatgtactggaactactgtggtataaaacaatatccactccttagaaagatcagcatattcatcttctatgtcctatttataagtgaaccggtgtgctcttccctctttattgagatttttttcaaagtaggaaaaagggaaggaaaaagcatttattgaccacatgccatatgccatatttctttacaaatattttcccatcattcttagaaataaaccccaaatgaatatttttgtccatgtctttcaaatgaggagattgcttagagaagttgaggagttcgtcaaaatccaccatgcttatttattttcttttcatcttacatttttacatatctagtgattgtcagatactgagttatccagggttaaacagaagttacagtctgtgttaccaagggcctcgtagattactggagaagacaaagatgcaaataggcaattataataaaaaatgctacacagacagacaggaatatattcaagtcactcttaggcgcttctcctcccaaaacttaatcccccacttccattacgccatggtgccttccagaattagcgcagttygcatactgaaggaaactgaggggtggtcagaaacccagtttgtgcaggaaaaaaaattgtggagawcaaaattagcttcagtttttaatatcagccattaattctgaggaacaacttcatccacttaacttgattttccatcttccttgagtcccaaggcaaaactgaaatggaaaagaatctacaggatgctttcatttagcaaagaggcaaacaaacccaaatcgagcagtacatcatagcaacccactaattggaagtctgggtaaaacatctctcatcccatttctaagaacttagctatttatccaaagcaagacctcttgccccctggagctctattccccaaagagaagacttctttaaagagatcgtccttcttagaaaaggagatttttctttcccattcagatatttctagattggttcacgtggatagagaattctatgccttttttagccactgtgactcagatataattcattttgccttaaaacgcaaagcatcagtaaacattgttagcattgttatgtcacccttttttttttttggttgttcacaaattttctttgttaaaatcctgtgcagctttttgaattcacactaaagaactttaaatttccaaatgaagaaatttcctggccagtttttggttttttttttttgaagatgactgctgcctgagtgtcaacatttgagaaaatatagaatttaatttttggaagtcactagatatagcaacctgcctggtgccagagaagagctgtctatgctgtactgcaatttgacttttaatccatcgtagatctgctaatggtatggcacatgtgaagtggtaaattcttgagtgtttgagacaaacattttaaggtacccatacataatgttaagttcacgtttaggaaagtagtaccagttaataagattacttatttgaaaataagaccagtttatttcaatctggatattcgaattatcaaataatctttttttttcaggattttcttggtgtatgttacctttttagtgaaggaccagtgtctcagagctttattttttatggtagtttaattatttaactgaaacctggaagaattaatagggtcagaattttagatcatgaaacatattttattgctcagtggatgatattcttcttggtattatttgctcttccccagagtcaccatatggtataaattattttaaattcccacaattatcagttatgtatatactaataatatcaaaatcatttgtttgggacattttttgtaatttattgaattttcaaagtcaattttgttcagaccattttttttttacaaagtagcttaaaggcacttagaaactgacagtattggatatttcatacgattttttagaattgcagtatctgccatttatctgaggactggtgattcaaaaactctgtttttggttaattttaattaaaaacatgtccactcaaaatactgctcaatacccaaatcattgcctaccttgtatatagttatttttcctaagggcaaaatagctaagaccataaattacgatggcaggcacatggtttgctgacagaactatataaaatactgttttcatcctcatgtcagctctggtacatgcctctttactttaattccttggggaatctgttgtaagttatagttttaaaaaacatccctaccccactagctctgtcagcttacctttttctgactgaccattttatttctctgaaagaacagatagaaactgagttatgtcttagctgaacttgtagtgccctaaatattaatagctgtgaaccagtttagtttaatttggatatttcccaatcttacacctgcgatattgcaaggtagttataaaaagtacacagaattcatctctataaatatatgctcattttatatcctttacaatctgtttcctagattcctaatccaaagaggccattagtaccaatgacatgatggatagagtaggttataatgtttagcagctcattggagatgacatagtttgccaagttaatttacacattttcatactacatatattatgtacaatattttttgtatggtgggttttcatcgagtacccttctctcttgtaagaaattattttttaagaaacatgttaaagagtaaagatgttttaaataagcatttctcaaatggttggtccttactaccaagcatattctggaactgacactttagttttacttacttccagcacatttcatgggaaatggagatgtccaaggaaacaggaagacgttaattgatgatacattttcttctaatattttgatatcccccaaagaaaaaaatagtccaggagatagattatactagaacagtttggctacattatctaaaagtatgttcccatggaaaattatataataggcttagtacattttagaccatttttttcattttctttttttttattattatactttaagttttagggtatatgtgcacaatgtgcaggttagttacgtatgtatacatgtgacatgctggtgcgctgcacccactaactcgtcatctagcattaggtatatctcccaatgctatccctccccctaccccacaacagtccccagagtgtgatgttccccttcctgtgtccctgtgttctcattgttcaattcccacctatgagtgagaatatgcggtgtttggttttttgttcttgcaatagtttactgagaatgatgatttccaatttcatccacgtccctataaaggacatgaactcatccttttttatggctgcatagtaatccatggtgtataggtgccacattttcttaatccagtctatcattgttggacatttgggttggttccaagtctttgctattgtgaatagtgctgcaataaacacatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacaatgtaaaagtgttcctatttcttcacatcctctccagcacctgttctttcctgactttttaatgattgccattgtaactggtgtgagatggtatctcattgtggttttgatttgcatttctctgatggccagtgatggcaagcattttttcatgtgttttttggctgcataaatgtcttcttttgagaagtgtctgttcatgtccttcgcccactttttgatgtggttgtttgtttttttcttgtaaatttatttgagttcattgtagattctggatattagccctttgtcagatgaataggttgcgaaaattttctcccattttgtaggttgcctgttcactctgacggtagtttcttttgctgtgcagaagctctttagtttaattagatcccatttgtcaattttggcttttgttgacattgcttttggtgttttagacatgaagttcttgcccatgcctatgtcctgaatggtaatgcctaggttttcttctacggtttttatggctttaggtctaacgtttaggtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagttggaagtcaggtaacgtgatgcctccagctttgttcttttggcttaggatggacttggcgatgcagactcttttttggttccatatgaactttaaagtagttttttccaattctgtgaagaaagtcattggtatcttgatggggatggcattgaatctataaattaccttgggcagtatggccattttcatgatattgactcttcctacccatgagcatggaatgttcttccatttgtttgtaacctctttaatttcattgagcagtggtttgtagttctccttgaagaggtccttcacatcccttgtaagttggattcctaggtattttattttctctgaagcagttgtgaatgggagttcactcatgatttggctctctgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttcctctcctgcctaattgccctagccagaacttccaacagtatgttgaatagtagtggtgagagagggcatccctgtcttgtgcaagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttatatgctggattacatttattgatttgcgtgtattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttgtttgtgtctctgtccggctttggtatcaggatgatgttggcctcataaaatgagttagggaggattccctctttttctattaattggaatagtttcagaaggaatggtaccagttcctccttgtacctctggtagaattcggctgtgaatccatctggtcctggactctttttggttggtaagctattgattattgccacaatttcagcttctgttattggtgtattcagagattcaacttcctcctggtttagtcttgggagagtgtatgtgtcgaggaatttatccatttcttctagattttctagtttatttgcatagaggtgtttgtagtattatctgatggtagtttgtatttctgtgggatcagtggtgatatcccctttatcattttttattgcgtctatttgattcttctctctttttttctttattagtcttgctagcagtctatcaattttgttgatcctttcaaaaaaccaggtcctggattcattgatttttttgaagggttttttgtgtctctatttccttccgttctgctctgatcttagttatttcttgccttctgctagcttttgaatgtgttttcatctaaatatttgttatattttttgatgaagggcaaaacattttggttacagtttctttgaatatttcattccacttacgcttttcaaccaaatacaataaaaaaagcaagaaggggttgtcattcttttttttttttcatttgttcttcaatttagcattgaaatattaaatccaaaagacaactacctttagtatgagattgtatattttgaaaatgtgcagaggtttaggtattttataatagtgacaatttacatatttataggaaatatagtttcaaatagattttaaggaggcagctgttaaaatttgacatattactgaaacttaattagtaatatcgaaatatttcagataacacagggatgactgagctaacctgattcaacacatcagttcacaatgttgtgaagaacacattgaacattttcatggaacaatgcattctgctgcttacttcaagaattaggaaggtgaataagatgattcttactctcaaagagcttataatttagtagaagaaagacaataagtctgtgtgcccatacatttattaatacaaggtgggtccgggtcatatcttataatttgtactaagtgtcatggggtagaagagaaaaaaacatttaatgtgatttgaaattgagaatgtttgtgtggatatgtattttatataagatacttataaaaaactaaatgcatcaacccacagattttttgtcttatggcctctgttagaatggtagaatgggaagaactatttgggttgttatatacacaggcctagttattattcccttgagtaaaatagggctttgttacagctaacctaataagaatatttcagtaatcaaatatttaaggaacattgttgaggtggcatggaaagtcaacacaaaaaaggaattccacttgagctgtaattttgttttatttgcttagcgtagattagaattgtgatacttgtactgttagttgcactgtacataaatattttgaattactgtcgctgattggaactaccttcgtgctttaaattaaaaaaaaaagatgtatctgtacattctaaatagtaaaaactctttttggctcaaatcttttaattctgaaggaatatactggcagatacttagtagacataaataatcattaatgcatgtatggtgtatttcattcagtagtaccaaaatctaaaacacattgagttgtctggcatggtttcattgccaaaagttgtgatgtgactctgatgtaacctggtttgttctgaacaactccaaatggttcttcagacttgcccaggatccatctggctcctgggaagccttatgttatcatggctataatcccagactctggtgacagtctgcctgggttcaaatccaggctctggtactcactatctgtatgaccttgaggatgttggtttgtctgtttcccttgcaaaataatgaacattatattccctatctcaaagggttgttgtgaggatactctaagataatgcaggtaaaagtgggatgttaacagcatttggtaagttgtaaggactcaggtgctggctatgtaaaaataaacttttttaagatggatagatacatagatagatagatagataggtagatagatagatagatagatagatagatagatagatagatataaaaacctatacctgaaaacattattttcataatatttcaaaagcttctattgtactatctatgcttttatacatagtaaaagcagatgacatgctggtcctactaaatttacaggttaatttttagatagttactaagaaatcaaactgtgtggaattttctggtacaaaattacaatatgcaataccttcctactgaggtacccattactgaatatttcttttctatcatatgtgaaatgcatcaattttaaatatttggagacatacctaatttaagtgaaaatctcggtatttcctgaaagtcgccacactataacagataaccaatcaaatttgtctagcttataatgtctgtcagcctgggtgatgtggatgggccactgtgttctcaactgcactgtctcagtgattggagccagttcatgaagcgctacagcctgtaggatgccaaggaggttctttttcgtaatcacacacaagcaatgtggtaaaaccctcaagggatagcagttgctttcacaatctatttacacacatacacacacatacacacacacacacacacacacagagttctttgttattttacatctggcaacaggaagagcatgctggacagacctctggcatcataaaccatccttccctctgacctctgtgtgaatcagcagactatgatctctgcagaatttaggattaattgcagcaaagaaaaagaacctctctgaaatctaaaatgtagacttggtcattagttcattttgcatgctgtggaaactatatttggcatcattaacagctgcttccatgagatgttgagcactaaaatatgattggtgaacactcaggattttattttgtggtattggttgcaattatggagatgttgatagatcaatttccacatcatctaaacccttaactaagaaataaagtggtacataatatgcatgtcccctctatatgagactttgttaattttcttaatttaaaaaatttttttaattctatgaaggaaaagaaatttctctttcagctgatgtttccctgaacacacattgtgatcatttactatttcctaagtgattcaagcagcaatcttgttttagaatatttcaactgaaatgccagccctggaatttcagtgctgattttaggaattattctaatgacttcttgacaagctttacctacatcaggagcaagtgaacttggcagagttgggataggagacttgcctccaaaatgttaacttatatataaccaccttgttatcgcattagttgttttcatggtggctgtggtggtcaatagcagaggcaatggaatgagctgtaataagagtcagcaaatctgagtggacttggcttctcccgtttgccatggtgtaaatatccccaccatgattgttttcaggctaccaacatgatgtcactaaatgtggaattgagaagggatgtccaaaatatacatcaataaatcagccctcatttgattttcttctcagtgaactatgtggttaaatgacttttatctacctttatctcgccattagcaggagacattatggaaaaatataatgccataaagtcacctctatgtcattgtccttgttagaataaaaattaagacctctaggtttacttttatgggttgagcctttgacctatctgtggaagtggtaagctggaacaacaaagaggaaaatgagagtctgtgcttttaggcaggtagttaatgaaggaccaggtaggaatgaagaagccaagttctagtccaaattgccattgattatctagaagattttggacaattcacttcatgcagtagctcaacatccatcaaagagtttttgaaagtctattatgtgccaggtgttggaagatgtgaaggtgaacaagcagatgatttcaccttaaaagagcttgtagcttagtgggaaggaggaaaaaaaaggaagtaataataacaaagtaagaaaagagctagcatagagctggggaagcaaaacacacagaatgaaagtggaacctgatcttgcagagtcctggaagggttctgggaagagatgactgtgtgctgagcaaggaagaatgaatagaaagtaggcaagaaggaagggtgagatgagaggcttcttgatttgattccagatctcaggttttatttcaccgttaagtatgatgttttagtctctcttttcttttttagaaaccttcactatgttaaaaaacagtttttttctattttttaattggcaaatagttttttttaaatcacaagtaagtattgtgtaattgtgtcagatttttttctgcacctattaaaataattgtataggttttcctttattctttaatgaggtgatatcatatcaaatattagaccaatattatgtatctgaaaaaatatgcacacacacatataaatgagtgtatttgtgtgtatatgacttttgagaatacattaatgagagagattgtactgtaagttttttctaataatacccttgtgatagcaaggttataatggccacataaaatgcattactaattgctttttatttctctttcttggaagagattgtgtatgattgctgtaatttcttccttacgtatttgggagaattcaccagtgaggccatcttggcctgaatttctattctggaaacgtttaaaattactggttttatttatttaaaagatttagggttcttcagattttacattcttctcatgttaactgtaagttacagtttttctttttttttaatgtgttgttattattttttgtatatgtccatagggtacaagtgcagttttgctacactgatgtattttgcattatggtgaaggcagggccttcagtgcctccatcactggaggaaggcacattgtacccaccaagcaaccttccatcatccactatctcccacccctcacccctctaagtctccattgtccacacattcatgatggacagtgtgcactctgcttccatgtgcacacattatttagctcccatttataagtgagaacatgcagtatgtgtctttccatgtctgaattattacacttaagataatggcctccagctccatctttgttgcaagttggtgtttttcaaaaaatttccttatttgggttgggcacagtggctcacgcctgtagtcccaacactttggtaggccaaggtgggcagatcacaagatcaggagttcgagaccagcctgaccaatatggtgaaaccctgtctctactgaaaaaaaaaaaaatctaaccgggcgtagtggtgcacgcctgtagtcccagttactcaggaggctgaggcaggtcgcttgaacccaggaggcagaggttgcagtgagctgagattgctccactgaactccagcctgggcaatacagggagactccatctcaaaaaaaaaaaaaattgcttatccattttattcaaattgtcaacttcattgacataaagttactgttcttatctttttgacatctgtaggatctctatcaatatcccttttgtttttatacctgatattggtcattcgtgctgtagtttttttcctcaataaggcttgttaagagagttttaattgtattagattttcccaagggcaaattgctggccttgttgatgttctctattgtacacttttttctgttttataaatttgtgccttttttttttcactttttctcatttctatttcctttgggtttgatttttcttttttgactttttgaattagagtatagattattgatattcaactttcttcctttctaatatatgcatgttaggccgtaagtttctctttaatgagtttcagctactttccctaggttttgacatggtattttctatattatttaattcaaaatatattctagcattcattgtaatttttctttaatccaggggttatttaaaaaatatgttgcttaaatttaaatgatttgaagattatgtagttatttttctgtatttgagttctagcttaattctaccgtggtcagagcatatggattgtatgattttggtgctttaaaatgaacttgttttattgcttatcatatggtccaattttgttaaacattcaatttgccctgggaagtaacatgcattttgcttattttaaaagcagtgcattataaatgcaaattaaggcatttatatataatgacatatatatgtgtgtgtgtgtgtatacatatatatgtatacatatatttgcttttgacttgtttcmtcagctactgggagaggtatgtcaaaatctcaaactttggttgtgaatgtactattctttataaaatttaaaactgtgttattaggtctataaacattaagaatgtttgtatatttttggtgtaatgacccttttatcagtatttttttcatatttatctctagaaatgctttgaagcctaatttgttattaatatatcaataattgtatttcaaactagattattcaattcatgtaaacccgatgtagttaatactttatgacaaatttatcgtgcttgagtttggtcaggattctcaattctatatttgatgtcttttatcaagttttgtaaatacttggcctggatatactcaaatatttcttttatctcaatctttatctctccatagcttttgggattctaattacttgtgtcttattcctttatgtcatgtctttatgttcttttctaccatttttatttttttctcaatgttttcatccagaaatttttctgacctattttcttattaattaatcttcttcttctgtgtcaattctgctatgaagcccgtccactaggttttaaattcaattatagaactttctgttcaaaaatttccactttattctttatcattgattttatttcactggtaaaattatctgtctggtcatctttttaaaaagtaatatgaataacagttatttattctaaaatccttatgtaactgtaatatttaaaccatccaccaggtccatttgtgctgagttttctcctggttttcagtcatttgattttgtatgtatgtatgcttggtaattttggattgggtgtcagaaattgtgtatgaataaaatgtaaaggttctggatgatgatctgttatctcagagaggaatgtattttcttcaggaaggaatttaagtacagatagaccagcttgatgcagttagaaagtgagacgattcaaggttttattcctgtcattctgacagcttgttattttcagtttctcctttgtcctaggatacagcccttcagaggtctcaaatgaaagacggggccttttttctttataggtcccaaactccagtttttgtctttcagttccattaaactatggaaagctctgagctactgttttctgttcagcctgtctgccccatcctgcttgtgaataagcagttgcctcaagtgaaataattttcctgctttctggatcttggtctgtcaagttctaactgtcttaatcattcctcagtatcttcaaacatttcccctgcatttatagttgttataagtactagtatgatctaagctattctgttatagctggaagcagaaatgctgccatcgaaagagattaggcattggaataatgtgatctgatttgcattttaaaaagatttttctgaacaacaatatcctcatatgtgcaatgaaacattttgataaaaattgttctctcaggcccttttcagctccaatattctgcaagtcttgagagtactaatagtgtgtcataccatgatttcaagctgtcaaaaccccagggcttttagttttagtaggctaaagttagaaaagcttagactctggggaaaatggccaagaagaagactctcatctttggtgtctttctatgtggcttcatcactgtacttcttgttagctttcagcaacatcctctcttttctgggtcttggtatctgggcacctagactatttttccagtaacctgaccactctctcctcatgtggtggtgccccattccacactctcttctaaaatgtttcatacttgagatttaaaattcactgtccatcctgcatttttctgattttttttagtaataaattaacatttattgggtagttatgtgccagacactgtgctaaacacttagatggaatattttattccatattagctctatgaggtagggacaattattatccccatttacagatgacaaaattgaaagttaggggagtcatgtagcttacctaatgttacagaggtaaagtggctgagatgaattctgatccctggaatgggcatcatttagaggggtggttcccaaaagccagtccacagactgtcttgttctctaatatataaaaaataattcagcaacatctaggagcataaatccagagattctgaatcagtagttcttggatggggcccagaaatctgaatttttttttccttttcaatgattacattttagtttactgtacaatgaaacagagaaaactactttttttttttttttttttttttttttgagacggagtctcgctctgtcgcccaggctggagtgcagtggcgggatctcggctcactgcaagctccgcctccggggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctacttttttttttaaagatctgagagtgtgaatcttccacctccttttcaaccaaagttgaggaatttgtcctgctataatctcaacccttgagtatttctttttttaaaaaattttattattattattattataatactttaagttttagggtacctgtgcacaacgtgcaggtttgttacatttgtatacatgtgccatgttggtgtgtgcacccattaactcgtcattcagcattaggtatatttaaaaaaaaaaaaaaaaccttgttatctcagtatgtttttattatgcaaatttcctctaaataatgaaagctcctttttaatgttatattatgatagcaaaaggtgtgctctttgtagagttagcaggatatggttgtgtgacaaaaagccaaatagtattttaggctccaatgaagaggaatatctgtgaagggggtctttcttggtatttttgaagttccacttgaaagtgctgttggccatcactaatcatgagggaaatgcaaattaaaatcacaatgacataccaccttaccccccagccagaatggcgattagtgaaaagtcaaaaaacatagattttggcatggatgtggtaaaaaaaaaaaaaaaaaaaaaaaaaagatgtttatacactgctggtgggaatgtaaattagtacaatctctatggaaaacaatatggggatttctcaaagaactaaagacagatcaaccattctatccgacaatcccactacttggtatctacccaaagggaaggaagttgctttatcaaaaagacacctgaatgtgtatagaatcatcctaagtgcccatctactgatgagtggataaagaaaatgtggtgcgtgcatgtgtgtgtgtgtataccatgaaatactatatatatatatacacacacacacacacacacaccatgaaatactattcagccatttaaaaagaatgaaataatatcttttgcagcaatttggatagaactagaggccattattctaaataaagtatttcaggaatcaaaaatcagataacacatgttcttacttatgaatgagagctataggtatttaaaggcatccagggtggtataacggacattggagactaagaagcggggaggctgggagtgagggtgagagagaaataactatgcattgggtacaatgtacactacttgggtaataggtacactaaaatcctaagcttcaccaccatacaattcatctctgtaaccagaagccacttgtatccctaaagctattgaaataaaaaaaatcacaaagtgctgttgcctactccacagccatgcaagtttgattctggatctgagacaagctatgatcacattgttgtagagaactgaggtccttggaaaataaaacacaggttcccaaccagaagttaattttattctgctgttaaaatggaactatgactttkcttatttataagaactgtccttcctttttaaggttaaaacatgttattttattataatgcaaataatattcattatttaaaaatagaaaaataagaggcagatgtagttctagctcttaataaacctggctaaacttttacaaatttcatctgatcatttatatacttttctacatgattggacttatttataatttggatttttgaatagtgctttaacattttttacttaaattgtatacattttatagattatctcttgataagcattattttaatgatatatatgtataaataatatatattcttacataatacacacacatgtctatgtaatgacatatatataatattttgcaatggtgcatatgtgcttgttcccttaagatggatatttatttgactgttttcttattgttggattattttgtttcataaataacattctatgctgaaaatatttttaattgctataaattgcccaactaagacatataacttcctgttatcctttcactacctttgataacacactaaatttttctttactatatttcattcccttcttaatctcatttctaaaaactgtatttctgtcttacaatatatatatcattccttcagtactcctacctgttgatcttctcattgttatttactggcttgtcaggtcttggaagataggcttctcatacaacccaagcctstcttttgacctgactataaatattttattgtttacatcttcccctgcaaagaattcctctaggatctgcccctttcttgttctccaggcagtatgccttggacattctgtagctggctgggactgattccttgccaggtcagtaggacagatgtgtagactaagaaattaactagtgagttcaagtggaggttcctggcctgttggtgcctgtgaacaggattcttttgagtatgattagtgacatgaaggtcctgaataatatcgtaggcagaagaagtgccattactactcacagtgtaagaagtagcttgagttaactggtgaaagagctaaaagtcaatgaaaagtattgaacttttaaaatgtattatctattgaaaagtttaaaagatcatttattgattaaggaaattcctttgactttaatagctgtgagctctaatgggggctagaaactccagcaagtggtacagtttctagaacctagcagataatttttcattgactagaattccatgtgtgatacaatgatttggcaaagtaaatcacaataattattatgttcattgttttctcctttgtttaccttgattaaccatctttggtgattgtttcataattgttgctttctaaacaactttattgaagagctacaaatggctagctcttctcaaccctttaattagtgtctgggatcggtggatgttagttgaggggaaaaggttattttaataatttaagacaaaacaatttagaaattgtatttttttgaagacaacttgctatgtaaccttttataattccctgaatttttctgaaattgatgttttctttagtgtatagcagtgatagcatgaaaccaccactgacttttttagggcaacttgctggctaattttataaaatttgaactgcactatatgaatgaagaatcatctgtagcaattgctcttttccaaatgttcttttgcttcaaatgccgtatctgaatattagattgtttctccagatgttacaggctcatgtttccttctgctgaattcaattgttggttcctgcttatgtttctcaggatttgtatcatttctctgtcttaagtaaggtttttataaatgctcatcaatgttgtagagtttggattcaattcagatagaggctatttccaccggacttttgctcatctacttcctccctggagaatggtgaaaaacagtcctcttttccctcctctgatagggtgatgggctactattgctttctctctcctaatatattgagtacaccgacctctcaccgaaaccttaggtcaaagtgagaagaggtgattgtttttaattggatgattgctaccatatacttctcttttggtgggatcccaaaataaataaataaataaatgacactccccccaaaaaagaggaactaaaaaaaggctgagaaagcatgccatgaaggtccaggcttggacaacaagcataccatgatgtgaattttagccccatcacctactaactgtgtgaccttgggcaagcttttgaactcaccagggcctcaatttcctaacctataaaatttttgtgatcattattataattacaactaagaataagtaycttatcrttttgctgcaatacacgcgtgataattgtcctaaagtgcttagcatggtgtctagaacgyattatgtacttaataattattgtctgaaaaaataaacacatgaagaaaataccttattgtcaaagaatataatactgtgccccaacttgtgaaagattaaacctcttgtgtctccaggatttctaatagcttatcccagaaaggcagtgcagaggacatgtgggctctcttcctactgcagactcrggctrttctgatggtggggtccaagggcagccttgcttctgccatttgctcagttgatcttgtgaacagctgcggttcttgctgtaactacttgctcgctctcagtgactctgtactgtaaatgtttcatgtgaagragcactgctctaaaacaaagctggaaracagggaggcaattgccagagctgtcattgtgctgagtcagggaaggcttcagcaatcatccaaagagatgtggcatttacacctgcagctggatgggttatgaacccaaataggtccttaaaaaggaaggctcatctcctttccccccaacagccccccacccactcaatttttgcctactttaagggaaggtttttggtaactaatttttcatctgctcattaragcttaccaattacagcatgtgttacaaattataggttccaggactttgggtgaaatrtgcttcgtaaataatggcatattttgctgtgagcagtccttgattttggactcttgcattacctttcatctcgcaaattttccgtataggaatacttggatgtacaaatttcaggcaagtatccgatgtatcttatagaatcagctacccgacaatattgtcaaaaagagaagcaacgctttcagatgatgtaagcatagaatcaagcaaggagttggttgaatccttcttgtgcttttcctttgagatcaccttatttcagaatcctaggaggattgaaacattcctactttgatattttcctctggagatcacttgttaaaagtcgtcaggagtgacatttactagtcttgtattttctctggtcttaacttgaaaagttctgctcatcaaaaatgagtatgttgagatgatattttctatagaaattttgtattttacccccttaaaatcctcacttttcacatgaaagtgtatgctcagataaaacaagactcatggagagcacatgggtgagatcatgctaggctctcattgctaggctgagatttgcatttttctgaaaatcagagtgctgaattttcttagctttgaagtagctaatgggacagtgtgtgtatatgtgtgtgtgcccacttgcatataattccgaatyacttgtttatgtgtagtatatgattctatgacaaagagctccctttaatgcaaatrtaaggcattcatgagcatctcatgtataagctcatattttgaactttgtttttcttttactcaaagaatttacaaaatcattttgtggtttgaaaagtaattcagatttcctataaaatgttatataaaattttaaatttagattttagctagcaagtattggcttaactgtagaaagaacttcattttctaggaccattcaatagtctagcttctgctttatgacaatctactcgtgttttttaaaggataataatattaaaacatttttataaatctcacaataatgctttatgtatattaactcatttggtccccacaataaccctgatggatgtcattattattatcctcgttttttttttttgagacagagtttcactcttcttgcctaagttggagtgcagtggcaccatctcggctcactgcaatctctgcctcctgggttcaagtgactctcctgcctcagcctcccgagtagctgggattacaggcgtgtgccaccacacctgtctaattttttgtatgtttagtagaaatggggtttcatcatgttatccaggctggtctcgaacccctgacctcaggtgatccactcgcctcagccttccaaagtgctgggattacaggcgtgagccactgcacccagcctattatcttcattttaaatatgaggaaactgagacacagagagagaatatacattaagatcagaaagctagaaagtctaggaactaagattcagaacaaaatcatctgattccactctctgtgctcttaaatacttcactagaataagtcttattttttataattgatacaactggtctaaatattaatgaagttttaagattcaatttacatatagcttctgtctctgtaagttaccagttattactacctaaaatacacttgkagtcaatagtaacattgaatattcctagattttattttwtaataccaaccagaataggaggcctcaaaayacctgtgatggaaaaaatgcagtgcctgagtgcatgcagctaagcctgatcactagaatacatttcatttatattttataagataccaaagacttcagaactacaaagagaactatagttgctgcaaccagaaacctattcacatatacgtacttttataaatcatgtgcatatgtgtgtgggtacctycatgtgtgtgcatatataaatacatctaaaagctgagaaccaccttagtctggggcattaaaattttagtaaacttttttgatgtatatgttgaataagttgcaaagttgaagtctgttccctgcctccatgtggcttacgtacacttgctaatgagaaaggagcttattacaaatattcatagatgtgatatatatgtgtacatgtgtgtatatatatgtgtgtgtatatatacatatatatgtgtgtgtatatatacatatatatatctttctccccctacacacacatacacacacccctttattcgctctcttttttttttttttttttttttttttagttggagtctcactcttgttacccaggctagartgcaatggtgcaatcttggctcactgcaacctctacctcccgggttcaagcgattcccctgcctcagcctcccaagtagctgggattactttctactatacaaattttactgtcatagacattggcttttgtacctccaaaatgtttgttattatccacggaaagggtacccacattttacttctatggataaattacacatatattgactgatagctactatttaatgaaactttttttgtgtttcagggtctcaactctatctttctatctatctacttatctacctacctatctatttttttctcaattaattccagaatgttaaatttcatgatggcaaaagtcattattaattttgttcactgacatactaagcacttaaaatgctgcctggcacatgtagagactcagaatatgctttcagaattgaatgaaaatatcttgacaaggtagcacagtttttgcttttgtttttgttttaatagagtcagggtattgctctgtcaccccacccaggctggagtgcagtggtatgatacagctgactgcagcctcgaactcctgggctcaagcratcctcctgcctcggcctcctgagtagccagtaccacaggtgtgtgccaccacgcccagctaagtttttattttttgtattttttttgtttttttgagatagggtcttcctcagtcttcaggtacaatctcagctcactgcaacctcaacctcctgggctcaagtaatcctcctgcctcagcctcccaagtagctaggaccacagacacacaccaccacacccagctaatttttaaaaaattatttttagtagaaatgaggtctcactattttgcccaggctggtctcaaactcctgtgttcaagtggtcctcccgcctcagcctcccaaagtactaggattacaggtgtgagctaccacacccagcctaatattttattttttgtagacacagggtccccttatgttgcccaggctggtctcaaactcctgtgttcaagtggtcctcccgcctcagcctcccaaaaggttgggattacaggtgygacccactgtgtcagcctctcattgttttccatctgacaggtgagaaactgaacctcagagagcatggattactgacccagtatcacagctagtgcagtgcagaagcaggagtggaacctccatttggctccactggccagactccctatctgtgactctgtctccaagaagctcttcgaggccagacagcagcatcttctggggtcttttaggtcacaagtatccctggtcttttcatgactacacatttctggctgactttagagctctagatgtttttctcctatgttgatctaccccgtaaggctccatgagaggcttggactattgtttcacagtaggcttcctaagacattttgcttagctccttgaaggcttccacctgctcttgagcttagraggagaatatggcctagtcaaagagagaagagcataatagcagataggagtaagtgagcaggaaacacagagaaatggtgaagaggaggaaagaatggccaatagaagatggaaaggcagcagtcacggtcacaaaaaaagggtccagaaacaatacaggagatgcacaagagatttcattgcttttaagaagtgttatgctaaaatatcttcctctatagggaaaagacaatggcaaagaacttttaaaatttttatttggctacttctatttaagtattaagtatatcgcggtgtacaataaatgtttacttaacaaaatacataaaactctttcctgggctaaaccttgaaagacagtcatacatatttcataagttttttgttgtaaaatatttgatgatttcgcagttagggggtttcttagaaagtgctatacataatcagatataacctttccattttatatttccttgtgtaagcaccatgacttctagtaatcttgagtgtctccccttttcaattcacttaggaattttgcatttaaactattgcccttgtttagggagaacaaaacaacacatccaaaaaaatgaccaaatgtgtacaacctggtattacatttctgatttacataatttccacctcagaaaagttttcttaaatacaaaactcactcactttattttaatgcccgaaagaatagcccagataaatggactccaaatttgaggcctgagtaataatgcattttaggattagactagtcatccttgctattttcgtggtgttcatcacgtacagagtacaacaagatactctattatcccttcaggctgttggataaatacaaataagcacatacaaccaaaacaaatcattgtatctgtgaattgaaatgcatgtcataagaactttaatctggtgcaattgctcttatagccaagtaaatatagtcagcaaagcttaccttttatgttaagcattttacagattacatatgtaagataaatttaagatttgtgtttaaatgacttttaaaagtaaaaaaagcattgggaagacttcttactcagaggttgtggtcagtcattttcaaataatttttcattgccaacatctcatacataaacttatataagcttctacaacccctcccagagtcagccttctctcttctttcagtaacatcctrtgttgccatctgactgaactgcaccatttgtcaccagttccaacacatcttgtcaacataccttttctattggaagaaaaaaagaaaatgggcttgaataaaaacatgtaaataaatgatgagcactttgctcttttggttgaattaaacagtgttgaaaggtgttagctagagaagacttaatagaaagtataacattttaaataatgtttaaggggaaaaagaaaaagayattttaggtttcagaataaataaaagataaaaataaataataaaagattttaagtattagggatgacttgcaaaatctcagaggtaaaggtaagaaacactagacagaaaataattttatttgaatttaaaaaatgggagagaatccacagaccctttgagggaactggatcatctttgcagactccctgagatgtcgaaaaactgtgagtctgcttgctttctcaatggggatgctcatggtatggggcaatttctcagccctgatcatctgctgcctggaaatagactcagtgctgttggtaggggatggtgggagtgagaccggcctttaggactgcaggctgcatgggagtggggtgaggcctgtgattgctggctttcccccacttctctggtatcctgtatgactcaacagtggcagccataatccccctgggaatacaacttcattagactgggaaccacatccccatcccccacagcagccacagcaagccctgccaaaagagaggctgaactcagacacacctatccctgcctccacctggtggtctttctctatcagccctggtagctgaagacaaagttcataatctcttgggaggtctatggccctgtccactgcctaagaaaccttaatactcaaccagatgtccctagggcaagtttgcaacctgtctataggaccacagctgatgcactcttgaaaatgacacctcctggctggaggctaaaccaaaaccagtgcattaaacaaaaacacaaccaaggacctcacagagtccacttcactcccctgctacctccaccagagtaggtactagtatgcacagctgcaagacctgaagagggatcgcatcataggactctgcagatattccccagtacaagcccagagcccagtagctccactgggtggctagacccagaagagcaaaaacaatccctacaattcatctctcagaaagccccattcctaggagaagggggagaacaccacatcaagggggcacctcatgggacaaaagaatctgaacagcagttcttgaatcccagatcttccctctgacatagtctacctgaatgagatgggaccagaaaaacaattctggtagtatgacaaaataaggttrtttaacaccccccaaaaatcataccagctcaccagcaatggatccaaaccaagatgaaatctgaattgccagaaaaaagaaaaattggaaggttggttattaagctcatcaaggaggcaccagaaaaaggtgaagtccaacttaaagaagttgaaaacgtgatacaggatatgaaaggaaaaatcttcagtgaaataaagagcataaataaaaaacaattgcaacttctggaaatcaaggacacacttagagaaatgcaaaatgcactggaaagtctcagccatagaatcaaacaggcagaagaaagaacttctgagctcgaagacaaggcatttgaattaactcagtccatcaaagacaaagagaaaagaattttaaaaaaatgaacaaaggctccaagaagtttgggactatgttaaatgtcccaacctaagaataactagtgttccygaggaagaagagaaatctaaaagtttggaaagcatatttgagggaataattgaggaagatatccccggccttgctaaagatctagacattcaaatacaagaagctcaaagaacacctgggaaactcatcgcaaaaagatcattggcttggcacacagtcatcaggttatctaaagtcaagatgaaggaaagaatcttaagagctctgaggcaaaagcgtcaggtaacctatraagaaatatctatcaggttaacagatttctaagcagaaaccctacaagttagaagagattggggtcctattcttagcctctttaaacaaaacaattattagccaagaattttgtattcagcaaaactaagcttcgtaaatgaaggaaagatacagtgtctaccaggcacacaaatgatgagagaattcaccattaccaagccagcactacaagaactgctgaaaggagctctaaatcctgaaaccaatactcaaaatacaccaaaatagaacctccttaaagcataaatctcacagtacctatataataataacacaatgaaaaaaaaaaacccaacttattcaggcaacaaatagcatgatgaatagagtagtatctcacatctcaatactaacattgaatgtaaatagcctaaatgcacctcttaaaagatacagaatggcagaatgaataagcattcaccaaccaagttttcttctgtttttcaggagactcatctaacacataaggactcacatcaacttaagataaaggggtaaaaaagatattttatgcaaatgggcatcaaaagcaggaatagctattcttatatcagaataaacaaaatttacagcaacagcagtttaaaaagacaaatatgttcattatataatgttaaagggattagtctggcaggaaaataccgcaattctaaatatataagcacctaacactggagcacccaaatttataaaataatcactactagacctaagaaatgagatagacagcaacacaatagtagtgggggacttcagtactcccctgacagcactaaactggtcatcaagacagaaagtcaacaaactctagcctgcaacaaatgaacttaaaagatatttatagaacattctacccaacaactgcmgagtatacattctactcatcagcacatggaacattgtccaagatagaccatatgataggccacaaaacaagtctgagcaaatttaagaacattgaaattacatcaagtactctctcagactacagtggaataaaattgcaaatcaactcctaaaggcatccccaaaccatacaaatacatgcaaattaaataacttgctcctgaatgatcattgagtcaacaaggaaatcaagatggaaattaaaaaattatttaaactgagtgataatagtgacacagcctatcaaaaccactgagatacagcaaaaaatggtgctaaggggaaagttcatagcattaaatgtttacatcaaaaagtctgaaagagcacaaatagacaatctaaggtcacacttcatggaactagagaaaaaagaacaaaccaaactgaaacccggcagaagaaaagaaataacgaggatcagagcagaactaaatgaaattgaaacaaacaaaaacaatacagaaaataaataaaaagctgtttctttgaaaatgtgaatgaaattgatataccattagtgagattaaccaagaaaagaagagagaacatccaaataatcgtaattagaaatgaaatgggagatactacagccaataccataaaaatacaaaagattattcaaggctactatgaacacctttacacacataaactagaaaacctaggggagatggataaattcctggaaatatacaaccctcctaggttaaaccaggaagatatagaacctctcaacagaccaataacaacctgcaagattgaaatggtaataaaaaaattgccaacaacaaaaaaagtccaggaccagatggattcacagctgaattctatcagacattcaaagaagaattggtaccaatcctactgaaaatcttccaaatgatagagaaagaaggaatactctctaaatcaatctacaaagccagtatcaccctaatgccaaagccagagaaggacataacaaaaaacgaaaactacagtcagtatccctgatgaacatagatgcaaaaatcctcaataaaatcctagtgaattgaatccaacagtatatcaaaaagataatccaccatgatcaagtaggtttcacactagggatgcagggatggtttaacataggcaagtcaataaatgtgatacaccacttaaacagaattacaaccagaaatcacatgattgtctcaatagacacagaaaaaccatttgacaaaatccaatctccctttgtgactaaaaacctcagcaaaatctgcatagaagggtcataccttaaggtaataaaaaccatctatggcaagcccacagccaactttatactgaagaggraaaagtggaaagcattcccactaagaactggaacaaggatgcccactttcaccacttctattcaacatcgtaccaggaatcttagccagagcaatcagacaagacaaagaaattaagagcatccaaaatggtaaagaagacatcaaattgttgctgtttgcagatgatatgatggtatacctagaaaccctaaagtttccaccaaaaagctcctagaactggtaaatgaattcagcaaagtttcaggatacaaaattaatgtaaaaaattagtagctctgctatacactaacagcaaccaagctgagaatcaaatcaagaactcaacccctttcacaatatcagcaaaaaaataaaatacrtaggaatatacctaaacaaggatgtgaaagacctctacaaggaaaactacaaaacactgctgaaagaaatcatagacaacacaaacaaatggaaacacatcccatgctcatggatgggtgaattaatattgtgaaaatgaccatactgccaaaagcaatctacatattcaatgcaattcccttcaaaataccatcatcactcttcacataactagacaaaacaatcctaaaattcatatggaacaaaaaaagagcctgcatagacaaagcaagactaagccaaagaacaaatctgaaggcatcacattatctaacatsaaactatattataaggcaatagtcaccaaaacagcatggtactggtataaaaataggtgcatagaccaatggaacagaatagagaacccagaaataaacccaaatacttacagcccactgatattcaccaaagcaaacaaaaacaaagtggggaaaggacaccctattcaacaaatggtgctgagatcattggcaagccacatgtagaggaatgaaactggatcttcatctcttatcctatgcaaaaatcaactcaagatggatcatatacttaaatctaagatgtgaaaccataaagattttagaagataacatcagaaaaacccttctagacattgacttaggcaaagacttaaatgaccaagaacccaaaagtaaatgcaacaaaaacaaagagaaatagatgggaaytaatgaaactaaaaagtttctgcacagcaaaaaaaataatcagcagagttaacagacaatccacagagtaggagaaaatcttcacaatctatacatctgacaaaggactaatatccagaatctacaaagaattgaagcaaattagcaagataaagacaaacaatctcatcaaaaagtgggctaaagacatgaatagacaattctcaaaagaagacatacaaatggccaaaaagcatatggaaaaatgctcaacatcactaattatcagggaaatacaaatcaaaaccactatgtgataccaccttacttcctcaagaatgaccataataaaaagaaaaaaaaaaaaccaacaaaaaatagttgttggcgtggatgcaatgaaaagggaacacttttacactgttggtgggaatggactagtacaaccattatggaaactaaaagtagatctaccatttgatccagcaatcccactactaggtatctacccagaggaagtcattatacaaaaaagatacttgcacatacacctgtatagcagcacaattcactgttgcaaaaatatggaaccagcccaaatgcccatcaatcaaccagtggataaagaagatatgacaaaaatatttatatgtacacacacgccatggaatactacttagccataaaagcaacaaaataatgacatttgtagcaacctggatggaattggagattattattctaattgaagtaactcaggaatggaaaaccaaacgttgtatgttctcactcatatgtgggagctaagctatgaagatccaaaggcataagaatgatacattggacttcggggacttgcagggaaagtttggggactggcgaaggataagagaatattcactgggtacagtgtacactgctctggtgatggctgcaccaaaatttcagaaatcactactaaaaaacttactcatgtaaccaatcaccccctgttccccaaaaacctattgaaataaataaataaataaataaattgaatgaatgaaccaaaggtattgcacgaggaagcaacataaataaacttagtgagtgaaacagtgaagaaaggggcaatgtgatggtggtgataggtatacaggttaccttgttcacccttttaatactgtggataaacagaatcaagtaatttgttcagctaactagattccatgaaaatatgtagccatttttctggctaaatgtaagaagagggaatgaacaattgggttagaaccttcataaaaagacatccacagggaagctacaaagatttcttatggtccccaacaacaagttcgcatactgtgcctaccttgtttttctcacagtttgatttcaatcctctcacattttgtgaggtggctgtttataccaatctgtggcctaagatattcttatgactattacttgtttatcaaaatggtacacattcttcagttgcagctccacaggctttctggaactactgtaattaacattgatttctttatctctttccttatttgtcatgtatgattakcactacatagaatgacatttactttttctcctttttcttttatatgtgctaattctgtctctttagcctagtcagaagctctgagttcgcagaataaccatgaacacagaattaaaggtctagatagatcttgtctaaccctttcattttcaaagaaggaaagtttgtaaaatggaaactacagtgatattgagtgtatactatgtgtcagacagctttaacatttttgtatgaatcactcgtgttgtcatctcaaaggtcatatggaatacatactattattgtcatcattttacaaatgaaaagaacgatatgcagagaagtggcttgctgagggcacacagctagtaagagacagtgctgggattcaactctagaccttctggctctagctcttaactttccaagttagtgctgcaggtagaacaaaaactctgtctcataacttctttctccatttcagggctcttgcttgttctaactaatttgtaccaccataattcttatactagagcataataaaacaaaagagatgcaagtgtttattaacttcagccttgtatttcacagatcctaaacatgtaaacatacacctgatacactctcatcctttccgaagagagcaagtaataatgttatactgagtgattaatgaactgatgtaaggactcagtaatccgcatgcaattagtggatcaacaaagcaatttacgcagtaggtatgtattttgaatagtattctttctgtagggaaccagctgtatgtagtgtttaattgaatgcttttgcatcacagagtgatttggagtcaaatcatcarccgcatttcccaatgtgtcaagtagacagttaacttatcaaaacttccgtagtactcagttctcttccaatgtgctccttatcttgaattcttttgaaatagtgtgccttataattttccaggaatgatttacatgtattcctgttcagagacagagggatggattacataacattccctgaggccctttttgccttcgagtaaatgctctttatcattctaagcttcttactctgagtaatatttgaacatgaccctgtggattccccataacaatttctgatactgtttccctagttgatatgtttggatattttccatactatgcaggctgaattctctttttaacttagtatgttctttttcactctgatgctttgacttttgccatcatagttttctttattttcagagtttatcgactgtcactaggctttcttctgagtcctttcgccaagtcatccatactttgctcttctaatcttctgttataacaggcttcctgttacttatatttttgctgttatactctgaatttgttccagattttctggtagagatttccctacaccaaaaacagtattccaggtgcagccacttgagaattgagtagagataaatatgtgcgcccctttttactgtgatgtcttgccatctgcagttcggagcctgtaaaagttagatttgggattgaaaataagacttccactaggactgccatttgcagcacaaactcacctggatggtaactgctgtctagccgcagctccctttcgacaggtccttctcagaagacttcttttccaggcttttttcttcctgtgcatatctgtgttttcattcattttcccctggtgaataagctggccctttcccaacctgactctcatcttgttatttgatcccaagatctgtaactcctctcagaccatctgcattatttctctgtccttgctgatgttttgcaacattctccagctgactatcatctgcagatttcattagcacaccatttactatgttctgaagatcattaatraagatgaataaacagaagagaagaccttctgcagacatctgtggaatttctctgggctgcccccacaactcgatcgccattgttttattttacctttttggttttttgcctagtgtttcattcacttccctccataagcaccctgttgtcatatctgagtaactgcactcataatgtgtgattttcttgcacagctttataattgcctaaacaattcatcatttgtctgacagcatttttcctttattaaatcccagttttattgacagttttcattatcttctagattgcagaagctatatgtaacaatgtgtgtgcccattctgatttctcctcaatttattactgttttaaaacctgtactatagatgataggaagagagtacgatgagaagagatagactcagaatctctatggctcttcttggaaaaacaccataatgtgtatggaagatcatgcatggggattttcctgcaaggcgctaacagtgaactttctatccaaaaagatagaaagaagttgtctctggttttgaacaatgaagatttatatctaacttatattgaaaaatcaaaggattagattttttaaactgaataagaaccatagctgtacttagagaatatctgtgatgcacttggcactgtgataagatgtgatgtatatcactatgattacaccaaccctgaatggcacttattttcaggtgtgacactagcctatggcggctgtcatgagrattagaaaatggtgtcccctccaggaggatactgcctgtgcctgagaatagagcacaggctgcatctaaggacccactgaccttctaggccagatatctttgtgtgtggcagagcctgcctaaatgtacatggaagccacgatttctttgtcatttaaatgaagaggataagatacctataaaagatagatttgagattgatactaatgtggttcctccatgccatattgtttctctgcacatagaacaaatatggatctaactcatacttctgtgattgcctactaaattcaaacagtactttgtgtttttacttagaaaagaatggatatggccgggcgcggtggctcacgcctgtaatcccagccctttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacctgggaagcggagcttgcagtgagctgagattgcgccactgcagtccgcagtccggcctgggcgacagagtgagactccgtctcaaaaaaaaaaaaaaaaaaaaaaaaagaatggatataatttaatatgtaaccttctcttccaatctttagctatgctgttgattttcttcccagtcttcagctatgttgtttttgttattgtcattattattattattatttattactgaatctagaaagaatcatggagaagaagcagtattactctgggccaggtattctttgtaatatctttaaaatacatttgaacgctgttcacatatccctttgtttgcctattagatccggtcaacattatgcaaacacacaccttcatgatattgaatattgatcaatttagtcacatgccatgcaaacgtagaaataccacttaatggctgggcatggtggctcatgcctgtaatcccagcattttaggaggccaaggcaggtggatcgtctgagctcaagagttcaagaccacccagggcaacatggtgaaaccccgtctctagtaaaaatacaaaaaaattaactgggtgtggtggtgcattcctgtagtcccagctacttgggatgctgaggcaggagaatcacttgagcccaagaggcaaagttgcagtgagccaagatcatgccactgcgctccagcttgggctacagagtgagactccatctcaaaaaaaaaaaaaaaaaaaaaaaaaaaaaactactacttatcaaggaatgttttgaatgctttaattctttgacttaaattactatatwtatttataaaggtgtagaagatttracaactggaatgtgtgtgtgcgcatgcacatatacacacatatgcacatatgtatatatgtgtatgtataacatatatatctataaataaaagttatttaccaaagcatcatatattttcattttcttttctttccttttgttagcattttcatttttcttgagtactgtttttattgaaatgcaccttgcactttagctatagagcttttccttgttgaacaatgtagttttcttgctcaacaactctgacatccaggtaaatggaaggaaaatggataggggagttgtgtgttcataatgccactttgccaccctgaaatctatgcagataatctacttggaaggctttgagccccagtggaatacagaaccatgtaagtatcctgcattgatttacagcacctgctacagctgcttggatcttggcaggcattttctctcctgccaaatgctgttgaaattgctgggctggtctagatggaggttatatttactggacatgtttataatcttcagagtgatctaagccatagagagctaatttcccaaagatcaatgactaagggaggatttcagaggttatcctctttatccaatttcctgtgtcctaatgagatggctgaaacctgtttggaatctttctgattaggaactcttgtgagagtcaataaagaatatgacattcataaatctaaataagaggcgacttggcagcctgtatggtgattcatgccacgagaagcctttcccctgcccccaacaggatgtgccatgggtggccaacctgagacaaggtcagacttgaaccaagagtcttgagaggacttggcctctcctggttaattcagaggactcttctggctattagaatgcgctgtgtatattttttacctgtcttgatttaattcaattcaattgccattcaattcaaacgaaatgtatttgttaaatgattattatgttttccaattaagaaggatgacacaaaaaaactatattggtatatggtaaggatcattatatagatctaaaaaagttttatcaaagatgatgataatcataatagctaatgtattttgagtagttactatgtcaggcagtgtgctaagcacttcacacatgttatttaatcctaacaaattcatgaattaggtcttattatacctattttgcagatgaagaaactgtgacttagatgcattaattaactttccatgttaacaaaatccttcccaaatcccatattcccctctcgctgtcttttgccccctctcagctaatcttctaggaaaaacttgtctgcctttatcatctctacttctttacctcccatttgtttctcaacccattgagttaggcttctgccactgccatcaaaatgaaaattaaacagggtcatcaattcctccacatgtccaatacagtatttttgtttcactggattgctcaccaccttttcccacaattaaccacttccttctggaaacagtatcttctcttggtttcttgtaccacatattcctgtgtttcctctggaatcatgagctgcttatctccatttgatagcacctcttcctctgcctaatttctcattactggagcattttagtttcggttctgggtcatcttctcttgcccctggattctgccctgtgtaggggattttaaacattgttggtaccacgtacattattggcagtctcatgaagcctatagactcggagtgcataaaataccctggatatctctcagtatcccaaacgtagttcttacaaatgggaactcttgttttccatctgcaaatttgtttttcctccagtcttgtccatcatcaatccagttgctcaagaaaactagaagtcatctatgattcctcatttatcctaaaacacaaagcttataccatccattagcatgtcttggctattttatcttcccaccgttccagattttcccactttttccttctatccactgccaccctgctgtgaccccttaggtggtgcttaatacatgtttagtgtatgaagaaaggtttggaatggggaaaataaagagacacactgaatcactaggggacatgtaatactctaggcaagacccaagatagaacagggacagtctgaactgaagacaagaaggatgaatttaaaagataagtgtgtccagtggaaaatacagacaaagaattaagagttacaaatgcctgttagtgtaatcgggttgtttgaagctatcttttaaaaatttccatttctttttaagtagccttttacctcatgttctgtgaagtcttttggagacagtaaatcatattgtttgggaaatttaagggtggagatgggaataaaactgaaaagaggaatctttcctagattaagttgacaaagaaacagctttcttcagccatttctctccagacactagtcaaacaaacaggtgagcaccagatagtttgagcagcagctggaacagttcaataagagtctccctctagcctctccttacttctgaataagcaaagttaagctacagtcaactagtcggcttctctaatattctgtattgttctgaggtttaaggctttgtttttttcttggctgtctaggctctctgattaactgagattaatctctatcatcctgtgtaagctaaaccctaaatyacataatatgttttctatctgtatgccatatgccttccatgtcagggatgactccagagacaacaaaagcaagctgtgtttttactgattttgcaaacttgcattcatcagccttgggcattttggcctccccagtgtcagtatggtgttttaatagctgagaaaaacaacagaaatataaagagaggacactgtgaaaatcactttccaaactgacttgtattgaaactgcctcacatctaagtaatggaaaataacagtgattaggataatgcggtgcattacattcggtgacagttaatcctcttattaacttcatggtcatatttcgctcatttgttaggttggaaggactgtgtgagaatrttgtagttcctgtttttctgttcattgggaaagttgggaaaatagttctaaaaataaaagagttccaggttgaaaagcctttgaggttgactgttctctctggagatgcatgtttaccttgtgccctttatccatgctttgagtttgggtacccactctttgaggcctcattctcttccctttagaggattttctttccacctgagcaatcaccagtgagggaaaagtcagtggggtggttcagctgcrtgatatgttgcattgacaaatggaggcagagccctgctccagccccgtgagttggaacaacctacaaagcatttctggcagtgagccaaagaggtgatccctcctctagggaaaaaaaaagtcaatggctgagattgcagttctccatccccttgctgggctgattcatacagcagcattgacactgaggtctcagaagaactgttctcttcccagtccatctaaaaatatctaaattcagatttataatgtcaggagctgataaatttgctgaggaaatgcaagcagtgtcactgccrtgctaggaaatctattctgatgaattgatgagggaaagaaattccaaacatagcagagtctcagagtgccacttcccctgggatggtgagcaaaatgagcatgttttccttgccatcgaagttcccttcttcaaacatagtagaaagtagaatatactagattgaaaaggaatatggaaaatacctttttgatcaaaagcatgacatgacataaaactaaatcttatggcctgtaaaatattcttggtttacgtcaagcaaggggttcccttttaaaatgctctttcactaagacaaaaattccactcacatagccctggtgacttttgattgaatcaggatcttttaaatttggaactcagcaagaaaccgactgtcttactttcctacaggttttgtttgaactttcagaatctaagttgatattgcggtctgctgctaaccagctcttycctctctttagttggtcagtggattctcaggagtattataggatgtttcctccataccacctggcttgaaatgatttggcataggcttcaactctaatttattcagcatccctttagcgcctactagaaaccaagtatcatgactggaacttttctgaaatgatgaaggtgccatggggacagatgggcgtgtaaagaacttattacaaatcaaatcataacataataattgatactgaacaattgctatgagaattgaacagaggaaatgcttctgctgggaaaagaccaagaaggcatcagagaagaagtaaaatttgtggttggggtgatacaatgaatgagtactagcaatttctcaggggagcagagtatgtctaacaggcagaacagcatggcactaagttaggaaaagtaccacctgccttagggacttcaacaagatatttgaagtgtttaaataatttttttttctcacttggattttggcttttgccaaacaactaacaaacaactgttacatttgatctaattattttagatcattaactttgaaaattgctgtttgtgtgatttcctaccttggccttgggcctattatgagctgacatctaatgaacaggtggctggtacattcctggagttttgcccttgtcaaacacttgacccagaccgcaaaatgtcatggtagctttccctgctgaaaccttgtggacttacagctcagtaacgatgttctaatgatctaacatgctatgccatcatttgttgattcataaagtcatgagataaacactaacattattatcactgtctccttgaatgaaaattaaaggctagacttttaattttatgcagtattttcttgactcaattatttgcattaaaaaatgtttaggcatttcattctcatggacctacctcttaatatgctttcttcttaatcaggcaataatttgtaggtttgggcctcaatttcaatagcaagtgagccccaaactcagtaaaaagcaaaaagggttttttttttctgagattcaatatgaaacacagcatacaaatatttcatgtaattttaaaaggtaatttagcatagatatgcatactgaagtatttaggggaagtagaaagatgtctgcaatttattttgaaatgcgtcaacaaatatgacggatggatagagggatagataaatgggtggatatgtttgaaagcaaatataataaaaatgttaccatctgagtataaaatacagctattgattataaaattattttaactttgtggaatgtttgaaatttttacaatatgtttggggagaatgataaggtagcaaagaattaaactggtagaggtgcttggataagaatgatgagatacttaaagtgaagagaaatttctctgacttatcaaaatgtagacacgaatgtagttgtgtctgtgagtcaaagtacacaatctctcttctccattagcttatgaatctgtcagatgagaaaaaagatcatcctaggagaaagagtagttcactgtaaaggccagaactttagtctacttggcaatatataaatagacttttggggtttatttttaatataaaacactgatatttttcgcaaataaggccatttctgccttctcagtcatttcaacatatattgagcacttcctatattcctggcatggtgctaagcacgggggctttaacttcaaaaagttgaacatcaagaatggagaaagagaacaagaaggtgatgtcacacacggaaagaaggacttaaaatgtgctgtgagagctctgaagagggagaagtccctggcttgttagctctgatttggggcaggctactaaacctttttgtgccttagtattttcctctataaaatctggccaataataaatgttaaactactgtctgttaaatagctggaccttcataaatggtcactaatatctttaacccagagaggaagatcaaattaggaaaaaaaaataacacagccataaaatttgtttgacagacatccttctttttcccatccctcctctataccccatcttttgttgccctagtagaatgataaaatcacagccctggagctggaacagacctagccctagattttggacagatattccattccaacccccatttagaggtgaagacactgaaataacttgagaaaagtgacttgtctcaggtcccatagctagtcaatggcaaagtgggtgaacatgtaggataataaagcttttactggagagagaggttgaagaaaagttctttggaaatatagtttatgatttcttaggatgtaagagagaaaatgctcagaaactttttttattgttagaagagaatgtgttttagtgtacctaaacacattgcattagtaggttctcaagaggcatttgttgacttgtattgcattaaacctctcctgctaattgtctgtatagcatggttaacccttgttatgtgggtaactgttcctttaattaaattagtttttaagtcttttagttatattttggtgcctataattgacagaatctatatctcttaaccccacatagatttatgcagttaggggtagtgaagattgcttctctctttgtgaaaatggaatgagtactcttgtaacatctctatatttgtatcttatttgatctgtgggacatagaacattttcttgacaagatagcgatttcccctagagatctgtcaattcacaactttgaattaaggtctctaggcgttctaattatcagagccaatgacccccgctggctttgacctccaatactttagctggacagttcactcagagcaaagatagaggttctttatactaaaggagaatatttcttatcacagaggagggaaagaaggagaataagagaaatagagggagtggaggggatgagagaagggaaagagaaagagagtaagtgagatgtcactgcaaaatgtttttaaattatttagttgatactattaggttggtgtaaaaatagttgtgcttttttccattaaatagtaatggcattattaaaattggcattattaaaagtaatggcaaaatggcaattacttttgcaccaacctaatattaaattttttaaaaataaaagtcatataagagactaagcaaatccacaataaaataaataagttgaaaattagtgaatgaaataggatctccacaaacaatgctgcagaatagtttagaaacactgaaagatatttctaacatgcaatacagatcctttcatgcttcatttgagaagctggtataaatagaaaagtgaatgtacagtctcagaatctcagaccagaaaacattctagagcacaagttctaagacaaaagaaagagaggactcacactctacttgggaatgggctgatttttgctccattgagcagattgcactgttgattaacaaggtagatctggtaagaagttgagacagagacaccacatgctgaagaatctaggctgtcggtgctttttggaatctcagaaagaggtcagggagcccttgtgactccaggaggtaaatgactttcccattgtttgctgttccttcccagcctcaaaaagtagggatgcagacagctgcttctgagggtgattttttttaaatttaaaagttccacctgggcatgatgcagttgctcatggctgtaatcccagcactttgggaggctgaagcacatggatccttgagcccaggagttcgagaccatcctgggcaacatagtgagaccctgtccctacttcaaaaaaaagaaaaaatcagcctggcatggtagtgtctgcctgtagtcccagctaccagggaggctgaggtgtaaggacaactttaatctgggagatcaaggctgcagtgagccatgatcatagcactccactccatcccaggttacagagtgagaacctgtctcaaaaaaaaaaaaaacaaaaaaacaaaaaaacaaaaaacaaaccttggaaaagtctatagcttcatcttatgcattattcccccatatactgataaaattcaagtcccttcatagaacccaaacagctgataatgtggcccataattgtgaattccccaagcccagcatttgaaaagacaatttaaaaaatgagagagaaagagagtcagtgctgataagtatgaggtaatgtgaatgtgtaggcacagggtgactttgtaagtgggaagaaaaggagggagaagctaactttcattaagagtcttctaggttgggtgcggtaaatcacagcactttgggaggccgaggtgggcagatcacaaggtcaggagatcgagaccatcccggctaacatggtgaaaccccatctctactaaaaaaatacaaaaaaaatagccaggcattgtggcgggtgcccccctgtagtcccagctactcgagaagctgaggcaggggaatggtgtgaacccaggaggcggagcttgcagtgagccgagatcgcgccactgcactccagtctgggcgataaagcgagactccgtctcaaaaaaaaaaagtattctgtgagccaagcgctgtacttgattacttgatttaatcctcgcaattatttttcatataacatgatgagaagatgggggtccttgtaagcagcagaactgggatttgaacccaaatctctatgacataggtccccatacattttctatgacattggttgtgtgccatctggctcatgactttccagcaatttcagggataaaagatgtataataatctgacattcaaaacccatatacttttgcctgtgttagctgctctgggtaaaactattggataaatgaggtttggagaatagatgtgaattttcattattcattcccttctgagaattgtccaaataatattatttctaccagggtgaaatagagggggaaaaaaaacccctaggtttctggaaatattgactatgggatataaggcaaatttagatgttaaaagtgatagttgccaaatttgtcaaatgccgtaatgttctcatgtacaaaaaaagttggggaatttttgtcagaaaattatgagttttgcactggccaattcaaatcaaagagtttttttttttttttcttgtctttggcaggttttacaagggggtgtccctgaggggaggtgaaatgagacctagaagcaatttttactgtaacacacacatacccatgcactaacttgctttcatatagttacctgtacatgccacatttcatgattaaaatgcagtccagaaaaatatggtgcactgggctatgtatgagtcccattctctttctttctatttttaagtggattttatgttgcctatttagtctgtaatgaccataagccactccagccaacttgttttaaagctcagagagaagtaggtcactaaacaatagaataataatgtggccacatatttaactttctagtacccacatttccaaaaagtaatttcatccaaaactatcatttcaacatgtcattaatgtaaaacactgttaatgagatattttgaattttttagtggtaggtcttcaaaatctggtgtaaatttgcactgacagcccatcacaattcagtcaagcccacatttcaagtgctcagtaaacacatttgtctagtggctcctgtattggatggcacaggtgtagactaggaaagcattcactcatggtgtttattcaatattttctctatcttctatcatttcttatattaagttgtagagagagagcgcactatttctaccccatcagagaacatgaagggatgcagagaagaatatgttgagttgactacctacctcacagaggacctctgcatgacatttagttgaagggaactgccttctctttttccaggaagattaaatctttatcctctctgccattcagtttaatacctatgtgcaaggcatcagtagagaccagatagatagatagatagatagatagatagatagatagatagatagatagacagacagatagataggcagagatgtttgtgtgtgtgtttgtgtgtgtgttgtgtgtttgtatctctaagtacatgaagaattggcatacatcccagaacacaacagactgaaactcctgattaaagataacaggtaaatggaatggacatccaataaaaacctgtttgtgtttttaaacaaaattaaaagactaaaataagaatagaatataggaataggaagaaagccctacatgacaataatcaatttgggtaccattttgttacctcctggccttctgcaacttaaagggaaaaaaaaattaccaccatcaggcaaatgccttatcatgataggacaaaattcttcccattgtatggctctgttggcatttttaaatgtgtcatatgtggctgggttgtggggtacaagatgtagacttgcttaggagacaaagaccagcataaacttttgaggatccatcctacatggagaatgtagtgaatatgctattgctctaagtggagacagagtcttgcatggcaggaagcttcctaaggtgaccacttgagtcatgaggcttagaagtctttgcagaagagggaaatgagccttcacattaggaaaatatgctttactattacataagttctgggatcaactgatacaaaagttgggagaaatcaaaattttaagtttttcctatgtgtgtacctatgatacaatcaagtttttattcaatttataactcctgaattcattcatcaggagtcctttaggaagctaaacagaactggcaggtctgtcatttggatttgtcatgattgtgagtatttcgttccctgcaattaaaaacgtctgtgggacaacaggatttcaagtcaggagattgttgggtccttgcttctgctacttagctaatctgtgactttggaaatcactctctgaatgtcattttgtttacatctattaaatgtaagctctctctgatagcattatgatgaggaaaaaatgaaagcatgtgtctgaagtatctggtacagaggccagcacatactggttgctcaataaataccagtttctttcccttttactactctaacaatttctcgtttgtattttctgctcctgagctctgtgtcttgaaaagttctgttggcatacacattggacttgattgcttacattaaaattatctattcttgtctctattttgtattaatgaatacaattaatctgattacaagtataaaactatcagtcaggtttctaaaaagttattaaaacatatatgtattacctgcttcccacattccagtgccaggctctgtagaaacaataatgaataatacagctattgccctaaagaggcttcaccaatcctgtctgtggttcagcatcaccaggcaataccaatttgtcatcatcatgctgaatggggagaggtttagaataatcacaggagaacgtaagaccagctcctggccccgtcttgatgggtcatgaaagaacaccgggtactatcctgagttgaaataattctagctcatagttaatctataaagccttatccagagaaattggagattatctttaagcattttgaaatattaagcatagcctgctggccccaaatgacattttttttaatatttacaaattattaataaaactaaaaatttccatcccttccctggaaccccaagcaaccaccgattatttattatttatttatttatttatttatttatttatttatttatttattcattatagagatggagtctcactatgctgcccaggccggtcttgaagtcctggccccaagtgatccctccgcctcagcctcccaaaatgctgaggccacaggcacggatgcagagtttgcagatgggcagctaccattttcgagtatgcagtaactgagttttgtgagaagagcaaagtggaaagggagaatgacttaattaggtctgtcctttagaaacaggtctgcaaaggcagtgttgcaaactaatccaagtgaaaaatcatgggagacttaaatgaaagcattcctgggaatgaagaaggcagatttagtaggattactaatgacaggttggatggaagatacaaaagagaagaaatctatattgctgtgatccattaagtctcattgtctacttttaacacttaatggggtggcagtgttgttattctaggctatcctttatgaggttggggttcttccctgacagttgctgaggctgtgggaacaaacgagttcatatagggagtgagtgaggaggaagacttcagacgctcagggattctacaccatggaggaggctacgaaggagatccattttcttctaaatcattctgataggcttctggatggctttcggtctctggccagctgctgatggaaagctctcctctctgatgaagattaatcatcaaacccaggagataattttattctgctcttctgagtcatgttagattccagaacaattaactttattttccccaaatcttgtatctcttgggaatcttccagtaactttggtttccagtctacggagctacttttggcagcttgttgtcaaagaagtgataattcttaaagcttagagtgctaaactgcaactcagttgagaattgaaaccttttcagtaaggggctcagccccagacacctgggactcctctttctcctttcaccctcaggtacaggagtgttacataaaatggcactaatccacttttacagtttttgtgttattaagcaatacattaagatttaataaccataacaaaagggttgttttctcaccaagcagttattatttgttgtacttctatttctactcatttaccttaggtttgctttagcgatttcaatttagtaggtgtctaatgatatgcctgtcaatgaaactttagagatgactttcagtccttggaatttttttttcatagtttcaagaagcaagacttgcgaagatgatttgcgttaagaggtttgtgtgagttgagtgtggacttaaattaaaagtaacttaatttactcagagtagtagaatctagtgcatttaaattggttgagaggtgcagacttcgctttggaagtcactgtaaatcgatgccgatagagtaaaaagcattctctgttctcttgctgttcctttttgaagggttcagaaggttggaagagcatccaaatcagtataatcagacctattagatcctagcaaagaattttaaatacatacatctttttgcatattgattctggcaatttaaccctcagcttaaaagcagaaagttggttcaagtgaatacaacatctcactctgcacaatattaagaaatagatctactgaaactaataaaagaattccattgttgtctcctccatttaaaaaaattctacctgaaatacttgttagaatttttataaaagtagtatctcatttatgtacaaaatagtttgtgtaaactataagtagacaaagatgtagggttgtatcacttctttgataagatactgatcttgtatttttamccaatgctaggcttaataaaagggtcctgtaaaatttactatgaaatctgtatgcctccctccaacttcttttccaactgagattggagtatggcaaaggaaatgaagcatgaagggaaaactaggagctatgataatctaagattcataaacaattataacattatttgctcacttttgattgtgcaaatgactaaatcttttaatgaagcataatgacccatctgacacatatataacaacacataataaaagataaaattaaatttgtcaaagcaatatagaccacccactactagtagattatgtttgggtttggattttcatatattttatccatatctgtttccttctattgggactttatggaggcattactcatgaactttggcagatcttttttggtgtgtctgaaagaaaatcccaaagctggttactaagatgtttgaaagtcatattcttcttcaaaccgtgtagaaataactatcaggaaataagtggttataattttaaaatggcatgtttagggaagagaatatataagtttgaaaaaccgcagtctcctccaatacatttctacctattactaacagggtcaaaattgtctacagaaaacaacctgatctcaatttcctcagacaattcagctagtaaaatggtgtgactgacctagagttacggagataactcctactgctgagctctctcaacaagtgacaccctggttgacaaacaatcacacattatttattaaacttctatttaataacaggagttatggagttagcaatgttaagtgaagagtccttgttttcaaactttgcaaattacagttagtaactaataaactaattaatgtcctttatgaagagatgctcagtgatggcctgaaaaatccctaaaggagatagggagagaattgaagtatggaataaaatgacctatatgggaccttcaaacttggagttttctatattttcaaaaattacttttgctgtcatttaatgtccaaatccaatcccttgtctagggaaccagttcagattaaacaaaatttcaaaaatacacaagcaatcaatatctaattcatttaagtcctgtttcttcccaggactgctgggtataagcctagagttgcctgccatttctcttatattcaaacactttgggaaaggagccatttttttagatctattttctccctgaagcttgggagctatatctatataaaatgagatgacatactagggctagcgtactaaaaccttttctaagagaatcaatatagctttgagaagcctcatttatatttaaaggagaaaagagacataagtagaagtggacataacgtatcatgtagacattgaaaaataccagaaatgatttaaaagtgactgcgtgttctcatattcccagtgccttgtaatttgacttggagggatgttctagatctccattgaatgtgctcactgagatttgtctttgtcgtattgattacaatcatctgtcaatgccctcaatattttctgtactgaccaacagcgacacagatcataggctgtaactagtacaggctgtgccaatgaaacaatagggctaattagcagacatgaaaatgaatcactgatttaattttcctcctggtctaatcaacacaatgtgtcagctaaatattttgatccattatttcaagtgaatagaatgtgcttttatattatcatttcaatttcattaccttgaatattggaatttttgatttttggatacatcagtgtccagtcagtatccagtgatttttagatacattttggatacatcagccttagcatacatcagtgcctacgggtataaggcactgatatgttaataaacatattaacagtttgtaagccaatgaaacctataattattgcataatttaaattaacttgtgtacaaaatgccataatatttccacatacgtggtggctttcaaaatcaaaataaggtgagcctatttcaatttatgacagacaattgtatatctcctctcttttctttgccaaagaagccctttatttcatcctcacaggtgttatacttgtctcctttctgcttggtgaaacaatcacggtttgtaatttcactttctgaccatcaaatacgataaaatgaaacagtttgtgcttttcttgtactttccgctatcaggggttactggttgagagagctcagcagtaggagttatctccgtaactctaggtcagtcatgccattttaataggtgaattgtctgaggaaattgagatcaggctgttttctgtaggcaagtttgatcctgttggtaacaggtagaaaatgtattggaggagactgaggtttttcaaacctacatattctcttccctaaacatgccactggctggctgggatgctaccttataaatgtgaggtagatgacaccagtctgtaactctagacttctgtcatggatagcaggataacttagactgagagctgtctgtcttcccagcccacatggccacaggatcagagcaggtcatggtgaagcagaggagaaacagctgcaaagcagagaagaaagtccaatagggtaggatgtgatgaataatgttgtgaaacagacagctagtgccagtaaggctcctatatcatagaagtctaggaagatacaagcaagtgctgtcatagacagataaatgaagtggacaytgttttgagacaaaagcaagctggcaatatcagagaagcttactataaagagcaaaatgctgggtgcactggctcatgcctgtaattccagcagtttgggaggccaaggcaggaagattacttgagctcaggagttctagaccagcctggtgagacctttatctctacaaaaataaaattaaaaactacctgggcatgatggtgcaggcctgtagtcccagctacttgggaggctgaggcaggaggatcgattgagcctgggaggtctaggctgcagtgagccatgacagcaccactgagccttggtgacagagcaagaccctgtatcaaaaacaataacaaaacacagcaaggaccctattactctcaatgggaaaaatcgcagttgcttttgggccagcctaataataacttgacagagagaattttattccctgcaagctacgagttcgttttctttaacagatgaggtaactgagccacataaaaattaagttacttgtctagagacacccagctgataagtaagagagcagacatttctactcaagcaatctgactccaaagctcatggtgatgaagcaggtcatgaaagctctctttatgacacatttgaataaagcagcatgacagtgggacaaaaagtacacaagacaaaagctccatcgttagggccaaagcataggaacaaactcaggccagtgatggagcaacttcagctgagattttagccaagagcttgttaacatctttccagttcccagatagaattagtcctaaggaattacgaacattgtattccatggyatatatatatatactacattttctttatcctctaatcaactggtgatggacactgaggttggtttcatatacaagagcagatgtcttttatttttttttttttgagacagagtctcactctgtcacccaggctgaagtgcagtggtgtgatctcagctcacggcaatgtctgcctcctaggttcaagcgattctcctgcctcagcttcctgaatagctgggattacaggtgcacaccaccatacccaggtaatttttgtattttcagtagagatggagtttcaccatgttggccaggctggtcttgaattcccaacctcatgtgatccacccgccttggcctctcaaagtgctgggattacaggtgtgagccactgcacccagccagatgtcttttttaatatgatgatttattttcttttggataaatacccagtagtggtattgctaggtcaatggtagctctatttttagttccttgagatatcttcatactgttttctatacgggttgaaccaatccatattcccaacagtgtataaatgttctcttttctccacatcaacatctgttgttttttgactttttaataatagctattctgactggtataagaggtatctcatgtggctttaaattgcatttccatgaaaaagaatgaaatcaygtcctttgcagcaacatggatggagctgggaaccattatcctatgtgaaataattaagaagcagaaaatcaaatatctcatgtattcatttataagtgggagctaaacaatgagcacatatgcacataaagatggaaataatagatactggagacaacaaaaatggggagrgagagaaagctgaggattgaaagatgatctattggataaaatcttaattatttgagtgtatacggagagcccaatcttcaccattacacaatacacccatgtaacaaacatgcacatgtactccctgaaactaaaaaaaaaagaaacaagcattgtgaactgctggatccccaagaaaggcagatgaccataactaggaagaaaaggagaaaaaatgtgcaatgtcaagaaacatttttgtaacttatggtcaatcttgtgtttctgcaactcacctacatcttaccatgtagaaatttagggatacaaaccacaaagattctgagggcctaatcatctctcctagacttgcttttgcattctggagtaataatctggaaaagcaataagagtagggacatatttatgattattcttaaaactgtgtgtagaaaaatacaagaatatctactccaaaaacctgcatgaagacatttgatagttagccaaaattcaagagactcctaatctttgaaagctacacattaggctggtgtatatgtcccattatttgaaattgcacctttatatatttgagacatttatcctattatccctaattacaatttccccactacaattcactgcacagtgcttccttagggagctgcttaatacatttcaatcttagaaggtcaagattccctcagccaattccaaactgcattgtcccattgaatagatgtggcacattctggatctagtgagaataacctatgtatattactttgaagtaatacaggtaggccattatagcagaaagaagttgagtaaatgttgatatttaagaaggttcataaaatatttgaacacaactgcaatccatacccaattctcagtggttttttttatagaccatgaaatcatagctaaagtcaacttcggttctgccctaacggagagccacaaataaccctaaaccatagataactcaaatgcatttttacttggcttttgactgctttttatgataattttcacagcacattgctcttctaattatgttttgtttgggatcatattaaaattaacttgtatttagtgattatgtgctacctgatgagttaaagaggagccctgggagtgtattgaaaaaccaggctgtggatggccttcagtactttacacaaagaaaagccaaatagttaaaaaggcattaaaaatggaaaggatgtaactagtgggcaaatagctccaggacctcagttgcatgaacttagtatatctctttcctcctccttctcccctccctcctccacgccctctttctcctagtctctatttccccttttccttatcctcttcctccatcttttttattctttcttggaggcatggaaagcaactcaaaagaaaaggagacctctatagtacatccgcactcagccttggatagtgagaagtactcaggtctgagtagcctcagacagtggagtcagaagcaagatgaactgtcagggattataataggaatggtcagggctgaaagcaaggcaataggtcaaaacctggcaacaaggaaagagccctggataagtagtttccataaatccaagcaagacaatttgttaaggcttagcatgcaatcaggcatccaaaattccatgaaaaccagaaggcagggtgaggaaggaacaggaaccaggcagcagttctgtgcagtggcaccaagtgacagcaagaaggcagcagtactaccaaggcaagattacacccagccaaaaaaccaccagtctgcagggcagccaattgayactccaggcagagccattcagagctgaagagaaagcactaaaaaaaagtgcagccacttctgtgattaaagacaatgcccatggtactaaagtaccgtcttggagacactggtcatagttgttaaagcttccagccctcccagagaacatctctatgaaaaaaatactggtacagcagccccaggcccaccttctggaggttcagcttttaattttagttgtttcaagtgctgtggaaaagactagacctgatccctcagttcttcatattgccttatgaacactggccagaagggaagcacatccctcccttttgttaatttcctccaatattgctaagacaaggaatttcaaaatgttcaacaaatattaagaaacaaaaaagaaatgaataaagaaaataagatgggcaaaaataagtatgcatgcaaaaataagtatgcatgaaacataagttttcaaatatcatacactgacattgattaatcatcactagctgtcaggagagagtgctgtattgagaaggatttagcaacccagaatgtcctaactggcttggctcatgtctgctgtgggtaaaggaaaagcagggagtgctgacaagtctgctttgtatttgccaccctttgcaaataggtactcaccctattcccaaagagctaatataaattacatatcactttatttgtgtttgatttattacataattattattagaataattcacataattataaccagaagccccaaaagagcagagaccctgactgatttgttccatggatacctccagcatctagaacaggacatgacatatagtaccccttcaaccagtagttgcctgacttttctgccctcatttaatggatcctgtctctgaacctgcaggcatcatcatatactatcgtaagtgatttccttagcttcctaaacccagraagaatccacattctatttctcatggtttttttctatctgtatagcagcatcaaagtgggccctggtttttagtttgagggatatgccacttctgcaaccagctggcataaatgtggcaattgacacgataagagaagctgttctcccagccagggaagaggcattaccaattacaggcctatactataactgtgcctttaacatcacttgcatgtaagaatgcaggtctctatgttagaagagtgatatctgctcacagcatctcatctcctcctcagctctcccagcatttgagcgctctctccgcttcgttttcaaccatggtagtctaatcactggcaaaccaccagtgagttgattgcagccctttataattcctgtgtagtgagatgccataatgacttttccaggagtttccacatcatctgtttactccatgtgacattccttccatctgtctactttcagtttattttactttattttttagtaacttcatatcgcagatgaaagtactgtgaagtttcttctcaaaaccataatatttttgttacgttgcatgataacctcaggaaacatgaaattctaagaatttaatactaatatcattttgggatcattttttaaagcagtaaaagactttatgttcatgttgtctcacttttcagaggaattcatagctttttattgatgtaagccatttcataaccctgtcaaggtgctttgaggaagaagttaactgattgaacatcaacaaatcctggaatgtttgatactaatgatctcagaaggggccctgcctgatctacattccacctgagcactccttaccaaatattgctcttgccttcctctgcagtgattggttctgatcactgtagagaaagcatggaagctcattttacaaggctgcatgtgtgtctggctgctacctagatgcatgtccttcttgcacaggtcaatccattctctggtttttctctcctttgctctactcccttacacagaaacctaatttacctgtttctttcttaagctcttcatttcagaaaaactcaataaggaaaattaaaaaacccctcctttaggatgtctctcttatttctgccagctttttgaagtatgtgtgctctgggcaggggtggggacaggaagtgtatgtgacaaagatcagtcagacaaaacactcctggcatgatttccattttagagttgtgaaactgaagaatgggcaggtaaactgatattttctataagttgtgagaccatgattcactgatttgtttaccttaatgaagcatacgtaaaataattgataaattattttatcaataatttggtaatttcctcttggggctaattgaatatagtgagtataattgagtatacggtgggtggctttcaagcgtatctttccaactttcactattttagtaccctggctagaaaatgataatctgatagtgaaaatattaattcatcctctacaaggttctgaagatactaacttctcagtaaattcagatatagattacaaccattttcaggatataataaagaaggactaaaggtatctctttggtatgtggttctttacggccacataaatggcttccaagtcttcatttccttaagttcatttcctgctaccctatggacattgctaccctctccttctctgggttacaaataaatggttgatggcattttaataacaaagattaaccaggttgccatgttaaggatagatgggagaagcagtttgggaaggtagcctagacaaggtgatggtcttttcaggaagttctcaggtgtctacaataggtagcagaattgggcctgagcaaaagtcacatgagcttacagcaccctgtgcagtcaaactctcaacttcacttaagctttttctttgctttgcttctgcccactcacctggcctgttaccacccactgttttaagcagctcttcagctgcacatctactgtcctgctctgccctgaaataggatgataggtaggactgctgtacccacagtttacatgtccttaccctccatgtaaactgtgggtacagcatttgctacctaccgtgcttctcaaataccggaagcatggtttggacagctgaaggcttagcaatcattccaagctgcagcatctccttgggcctcaggctaacacccatatcaaaacaacttgcgcggtggcgggcgcctgtagtcccagctactcgggaggctgaggcaggagaatggcgtgaacccgggaggcggagcttgcagtgagccgagatggcaccactgcactccagcctgggcaacagagtgagactccgtcccaaaagaaaaaaaaaaattatgatatttaaagagcatatttaaccattaaaatagtaaatatgttgcttattttttttcttaattgaactgtagtgtccttattgttttaagacttcatcgtatattctggatacaattcctttatcatatatgtgatctgtatgcattttttccaagtctggcttttcattgtctcaactgtgtctttcaaagagcaaaaattcttaattttgatgaagtctgacttatcagttttctttttagtcaattttgcttttgctgtagtagctaggaaatctttgcctaacacagtcataaatattttcattttttacattttgtgtttaggtctcccgtgcattttaagttaatatttttacatggtgcaaggtgtatggattaaggtttgagaacagacagacaggaatgtctttcagatttataaaacgtaaatgctatatagttaagcatttaataatcttttctgaaaaggaaaaaaaaatgcctacatttgaaaccattctggaaaatgtaagataatgtggttttcctaaccaacagtagtcagcttttaaatgcagtactttgactttattatcttatcattgagattcaccatgtttttatgtaccactaagaaagaaaaagaaaaaaactgattaaattgtttaaaaaaaaacaaaaaccttgaagacaattttagttacctccaggctaatcatttcctttttcttttctttcatcgcccctgaaactcccccaagcattatccaaggtgtgggctctttttggttagtaaacttcacttgtcatctcctttgagtgtgcttccccactctcgtcatcttctgctggcttaactcgaagcccaaatttcttacttgtagatggttaacaaatattccacattctctgcattttcttcctgcatttggaacctgggtttcctttaaggacaccaactccttgaagtcacactccccctttctcgcacgcatacacacatgctcagacaatgagggtggctatctggcagcttccacctttcccactagagttttcaaatatttgccacactatgccagtgccaaaatttatataataatctatccttcagaggcttctccccttgagctgctcacaatttacccctccttctaactcacaaggagttacaaggccctggaawtgtgcctccctcgacagccacaagtgaaatagtcaccaggttcatggtcttactcgaatccctgtcatgcagggatttcttcatttgcttggaatgactcatcaaacagcctagctttacagttccttgacctcggctcttcccaggacttttatctccatatgtcgacaggaatctactttcttggcacttgttactaactggaactgtatctattatcctttctcaacaagaacctctcatatctcagcatccttctaaggctcgcttactatttcacctcttctgtacttctaactttgagccttttattcccttcctatttgcaagcttcctaggcttcatttttaggaccccaatgttgatcacttgaatttccctttcaccagctcactgactctcttggcctttcaactcatcctttttacaaacccctggagcaggtctctcatcgcccttcaccactcctgcagccagtcagaacagctggtcaaatgaatacaggaatggactcactcattcataccaacggtgttcacttgacctgccataacagtgtgattctacaggccctgcaagttcatgctgactgtatatctcactcttctgcctcagagctagagaaaacaacactgaaaatgaccaaacctcctaatcaggaactggtaaattaaactgtttaaaaaagttctctttatatgtgtacatacataatatataacttcacagaagtgagcaaaagtgattacactgtatgtataaatttatggggagaaatgtagcatctgaattcttttcctttttggtttagtttccagttcccctcttcccattctccacaccaacatcatccctcacctcataaacctacacctagaaaaactatgtcaataatctagaatgtatctgggattttttcccaagttcatatgcttaaaaatatatacacactcatacatataccatcatatacttataaacacacaagcatactgtggatatacaggcttttgggctttgttttaaaagatgagatcataatatacacatcttctgtttcttgcttttgtcattagatatcttgtagatatcactctagatgaaaaggttctaactatttttagatctaattattaacttgttcctttgtataaactcgtaaatatttattgagcacctaccatatgccacactgaagcctgggatttattcaaatttcagaattgagaagggagtagagagattcatagtccagctctcttacagaatagatggaaaatcaaggctccgtaaatattcgtgatttattcaaagtcatgcagccagttgatgccatgtctcaaatcaaaatctagctcttgctagcccccaagtccagtcctcttttaatcatactattcagagtcccataaattagcatacaattacttacaatttaatgtgaaaacatactacaacataagataaatcttcaggcctggagtagggagaggatagggaggggcaaggattcaggaaatttcctgataatggtttgttgtctgtgtggatagaccaaattgtctttaatgaaccaaatttatcaaccagtgaagactcattaagatgcccagcatttaaagggagatcaataaaagagagaacttagtattgaaaagctatgaaagagctttgaatgaaattcactctccgtcttagcagagcgcttttcaagagtgagaatcatgggtgggctgtgagggaagatattccctggccatctaagcacatctggaaaggtccagatttcaaactgtcgctcttttgtcagtgctgaaaaacttaaccttgagcgctaggaagatgttctccaagatgctgaaacttgtcacgttatatgagtcttcatgttcataggcaaaacaaaacaaaacaacaggcatatacatgacattaccttcttttttgtttgagacagggactcgctgtgtcacccaggctggtgtgccatgatcctatcatggttcatttctgcctccaactcctgggctcaagtggtcctcccacctcagcctcccaagtagctggaactacaggtgcactaccctgcctggctaatttttttctttaaattttctgtagagatagtatttacctatgttgcccaagctgatctcagactcctggcctcaagtgatcctcctcccacctggtatgaagcactgtgcctggccttgaatttcttaatgatgtttttgtgaatctatttgtcaagagtacaactgccagatttttgtgcatttgtgcccctctgctccgaagtacccygactgtcagtctattcattcagtcatcaaataactttggggcatctattctatgccaggcactactatggtaggccttcaataaagggaggctatgtttacatgggccttccacttcacaggcaagaaccgcactactgaatctcccgtgtctttgtccctccagataatttagtgtgcaccttatgaccttcactgacaaaatagcgaagaatgaacaaatgttccttaaagccagctaattctttggttattttaaagctgattggatcttttgtacacattctaaagactctaaagagagtccttgaaggcataatttcactgaaagacatgcaccacaaaccccctgaggcatccaactgcagggaacacctcagctcagtcagtatgtgatgagctttcatgtcgcagggcacctgacagttggatgaaaaattgctttcagtctgtgctgggttttctgtggcagttcagaagcaggactaggttctgggtctttactgtgtatgtcatcttttctttcagggttctgtgtttccatgcaaataattataatagtgtagaattatttgatacctactaagtgtcagatttcctgccatgtacttcacagacttttattctgtacaacaacattatgagtcatgtaatatcatccccacttcagaaagaaggttcggagaggtggggtaagttacacaatgacagaactacaagaggcagagcaggggtgaagctcagatccccgtgtctccaaacccaaggctgaaaccgctggctgcactaccccacacagttctgaggcagaagagaatcaggaggtgaggatgggaactggggaaggggttatgttctgatgagttagtttttaaaggagagccagattttctgaagcagaattttaaacatgaataggacatgttaacttgatgttagtgaaatatttcctagagttggggtttattgttgaatactaaactcatgggagtactgcataccactgtggaaaggtgaacagaatgactttagggaatgtgacagtttacaaagaaaaaagtaaagaaaggaaggaaaactagaattctcagtcctgaccaaaactatctctaggataattatggtttatctaaaacttgtttctctgggtaatcagataaccctgctctctgtgagtgtagacttctccacatgctgtatgaggatacctctgtgtccctgtagttaacaattttaattataggtgaagtattcaggttaagtggcctaaattgacactttacatggagaaaaaagtctctcatgagactatatgctataaatacataattattcatatttaaactcaacattctattgcttttatatttgttttatattcatttttcacaaagtttcctttgcaattgattcctgggtgatggtattaacatgtcagtattatttattcaagacaagtggaaaatctcaagaaaaggctaaaagacccttgggagcttacctagtgactacaacagaactaggaattaaatggctgtaaagtgacatgttgtatacaacacaacataatttattatgtgttgcattaatatagacgttttgaggatatcaacattagctgaggaatcctgatgtctgccaattaccattgtttggtaaaagattgggagttctggatttaactgcttggtaatgaaatcaacggtttgcttcaagttaatgttatacagtagatgcctagctgatttcttgtttcccctactatctaccttaaacgcattctgggtctcccttcatctttgtaggtttctgagctatttttgtactgtctacatatcttgattagctaatctgtatattaaccatacgttctgacaagagttcagtgacatggaccctcagcccatgacgctcactaccactgacatgttgcatgtgagtggtggggggagatgaaattagtttattataatatgacttttgagaagatatagcaaaataatcctctaatccattctacagaaaaccttttgtttttccaactttattacctttcattattccatctcagctgttttcactttgtgagattgctagggtcaatgggtgaggatctgccatgggtgtgtgtgtgtgtgtatgtgtgtgtgtacttttcactgtcaattattctaagaaaagcaaatgctaaagtgaagtgaaacagacaatggttcacagtaaatatcaagctgtgtttgtattgctgccatctctttgggagaatttcttatctgttcctacagaaaaattactggaaatatatatcaatgaaaacgtataaatgaaatcctgaaactatataagattcatatctcttgattatccaaaatagagacatattattacttatgaagatgaaatgtttgtggtttgatgctaaaacatttagtactaataattattccatatacagtgttcgcattaatctcgactacactaattcagagcatgagctctttgcctttgtgcatgaagacagtttcttgggcaaattaccaatgtaatttcctcgttgtcattccgcaaaccatctatgttcaaatattttaaaagcagctgtacagaaccaaataatttatattttaattctatataaatcaacatatacttctttacttggacattaccattttaacttcaaattcaacatgtctattttgaaacccttgatttccaggataaatcagtctcttgctgacttcccttctcttttgtttgtggtagaatgattcccctaatgttggagccttaaagtctaacttagtgactcctctcatgttttccatatctagtctggggcaacatccagaaattcttcctgttctgtttttcaactatctttttagttttatttctagtgccgccatctcagacctctactaattcattggaattatttttcatctctctgtctaccatttttttcttcttccaattcatcctatgcatcaatgtcactctattttttcatatctgcaaaccactcagtggacatccaatatacaagcaaaccaattataggtgaaatttaaaaatatttattgtaatttataaaagaatagtaaactaaaaatgaatggtaataacagcaattataataatggaaaacaactatgatgctaattaggaggaggaagaatgttttcaaagtctttcaccaggtatcgatattcatctcaaagagtttgaacaacagattcaattctgtgtagggaccatttcttcatttattctttattcctactaaatcagaaataccaaattcataagtcatttggaagggtaacaaatgtttgatggtttgtcaactagtcttgacaaacggattctacaatgtacagaaattatggagacagttttcactgatagatgttcagtgcctcaaaggaaactcattaagatgagggaatgccctctcaaatgtaacaggattgttgaatayatcaacacaaaagatcactagcaaatggattcctaatgaattcctggttgaatttgcctctgataattatgtattcatattcagtttgagcattcagatgtgttaaatatggccaataatagcactgatttatttcctcctttaatttagaatatctttaagtagttagaaggaaacccttgttaactaatccattgacatcaaaatttaactttttaaggaacttttgctgtctctcactaaatattagaaatgatgatatgttgttcatgaagtcataaagtcaggcttctccactctctgtttgatttttatgtgtatgtgctgctcataaaaatcatcacactggtagagattcttgttctcacaatgcagattcacagtgtattttctccctgaaaacttgttattttctttggaaactttatgccaaatgatatataatttgcagtactattttcatgtctttctacttttacatctccgatggattaatgttgcagcattaattcattttgtgtgagttggtactctaaaatacaataaggcagacagctttaaacccatgtgatgtttaatatcctacaaagaccaaagagtcatagtggatatttccctcaatctaaaaataagggaaaatactaataagcaaattatgtaaaaatgaatctgcttaaatagacagcaccctgtttgccagatgttacctgagacaaccaatccatatatcccatgtatgtgagatgtttaaaaatgtaagaattactaaggacatgataaatttttatgagaatcataattaatcatatagttcaaatttcatggtgcctgtctattgccaacccctagtttttcacaggtttcacattggaaagcaatgggttgtcctttggcttattttattttagtaattaactgtcctttaaaaacaataaaactttcagccttcagtgactttgataacctatgtgataaagtcagaactcattagcctgatattcaaggtcttcccagagaggctccatcttacctgctctgacttctgtcttatacctgctgatccacctggggtgtctgctgaaagcaggtcagcacaatgactcagattcttccctttctttccctctcccatgccccaggatttgtttgtacaactggcccaggaatcctgacttcatttattctctatgggttaacccaggttcttgcttgtgaatggaaacaggataatggagctaaacctaaatggcattttctaaccatgtcttcattattcattctctgaaccatcctctctaatcagtttttactgatttcttccccaaatatgcatttgctttctcatttcaacttatatttacactgttctattcatcagaaatgtccctgtcttgtctgcctcatcaaattcttcaactcccaactcctgtcttacttcctatataaaatcttattaggttaccttagctgaactatcttcttctttctggaattcctattgcaattacttttgttgtaattatttaggcagtggtttctttgatatcatttactgtgttttctggcaattgcactgaaattgtatactgctcttcaattaatgattatctatttccccaaactagattttaagcaccttgaggacaaatattgcctcatatgcctgtatttctgttccaggtctttggcatactgttaataatgaacaaatattatattacagtaaaactgtatcccaagattttctcagactcatctaaaatataggcaagaacttaataacactaatatgcctgttcaatgaagcattctattcaaaatgttttattaattctttacagcttcctcagcatctgattggaatcagtggcattttaatttatatgtctatttaacaaatactaatatagtgtgcactgtgtgttactcattttctatgcactttacaaataataattttatttaactttcaagacaaccatctgaaataggtgctattattatccctgttttatgtatgaggaaatggatttactgagaagtaactcagccaaggtgatggaattagttactaataggttcaggatttgaacctacatttttaaccactgtgctctaggaacttagttaacagctttaatgaatgaaatggttctgctaattgatgtaagaaactacttacatgttttgttggctaggtcacctgtcactctcagttcagaatctttcaggaaatgtcctttagtctctggtgggaggtgtactgcaactaaccgtcctttgaatttatgttgccatgtacagtccctgtaattttatttcctctttctatctttacttttgggatctaagcttccttgaatgtttagcctttttgtctttttagaaaatattgttccctttatgaatatgtctcttaattgctagagtttcctaatagccaaatgaaaattacattttggcttagaaaatgctttcatctgtatccactggctatatatctgcaaccaaagtaaagtgtggaattgggtatttgttgtttgcagcatttgagcagtgtacacatcaaatgtggttaattctattaccagtaatatttctagtttcttctaaaattaccataaaggtttaggtctagattagataattatttccaatcaatctcctttcaagttggaaatgaatgaagtcccatgttttctgtgtgctatttcatatattttggcatgataattattaatagcaatgtattactattgctcttttgcttacttaaaagtatattttgcagtggtttattttattctaggtgggagaataacacgttgatatcttcttgaaataaaaattatatgtcaatgaatgtgacaatgttctatgtaagtagcaatcgaggaatgactgaaaagggattattaaatatttcaatgcatgggaaaatatttcttctacctatttactgcctaaagtaaatgctaacccagaagatatttatgtcttggtttagaaatctgtagagtgacagagcaatctgagctctgtaatgtatgcaaaatttatcaggctcagagagacatgagtatgggactttggccacataccatacctgtgcccagggacaactgttaggaaacattttgttccagactagttgtgtcacctattatcttcatgttcctggaatttgtgatacaaagaacaatgtatagccaatcgatagcttatgtatttgaatgtatattcttggtaaacaacttaggaactgcctcttgtttttttcctaaaaaaagccacttgtaatggctggtagttggagtgtataatcagagcaacttgaatctacgctcctgagtggccatcttcaacaatcaccctggaataaactctttttaaactagaaaacaaaaacaaaggaaacaacaaaaaagaagaaatctatagagtgaactatatttttccaccttgcaaatagaaggggcaaaaatcaaccttgcctatctgatgatttagtgtcatagggattccaaaatgttatttgtaacgtgtaccttgatatgctaatggtgaaatctcctgtttcttgatttggtcttctcatcttacatttcttacctcaaatccattctgcgacttcaccagcagattaatattctttcctggtctcttggaattttaataaaaacagcatggtcatggggtttcatgaagcttgcagccctctgggggatgcagataataatcaatcaatctcataattaaatgtaattttaaataagagcttacaaaaaaaaaggaatatggtgataatagagcctagacaaagggatattacccagttagtagatgtgtatatgctgggcaaagggattgatatttaaataatgtacaggagtcatctaatcaaaatggtagaggtggtgggtgaggaaggatcttttgtgaaaatggaacaacatgtataaatatataccatgatgggcaggagcacagagattttgagaaaataaagctgtggtcgcagtcacagctcaaggagacagtgggagaagggaattcggtgaactggtaaaggtggcaggatcatttggtacctcataggctctgattaagattcttcctatatctttagagctgttgaaactcactggagtcttcaacaactgagtgacaggattagatttgaaaagatcattcttgctatggtgtagagaatagtcattcttagatcattcttgctaaatcttccatgagaaagtgagtaacatagatttgaaaagatcattcttgctataatgtatgaaacagttgggaagaaggtaagttatgggaagaccatttgaaggctatcacaaagagaaattctgatcatttagattaggtgatggagagaaaggatgaggaacccagaagatagtgggaattaccaaggcagagatgtggataatacagtccatgactatagaacaggaagtgctgaaagagcatgtttctgcacatttagaattaagagggatttggagcatctggagcagaatttgtttgttgggaatgatgactcgggagaggcaggtaggggccaaattatgaaggtccatttttgtgatgtgatggcaaaaggaacaactgaataaattgagcagggaatcacagtcagatgtggagtccagagaagtctctgatggtgtggaggatgctccacatctctcatgaaattaattgagaaactgctatttttttcatctaagagttttaattatctttcatttagttcccagaggctattgggcataggcacctagtaagtaactgttaataacaacatgcttattttgggcatggcaatgtggaaatttattcctgccgagtaatcagtgccagttttatgctggcagggttttaaaagaatggagaagggattcttttgcctccattaggagaaagctgtgccttctcttcatcatatagtgactcattcaaggttggcacaaagtaactttaatcaattaatgtgaataatatcatacctttttaagcctaaaatggatattagaggctatcagccccctggaaaaaagtctgcagaatatttttctttcaatgataatgtcatatatatcatagcccttgaatctttccaaaacatttagtcaatactgaaaacatccctagagagacactcatccaatttctcacatgtgaatcttttatctatctttggaaaattttaagaagtgcttaatttcagactgcttttataaaggacataactagtagcatggtaaaagtgcagtccatgaaattaaattcctgatctgaacctcaggtcaattaacttctaaaaatactctttttgagacaggatctcactctgttgcccagactagagtgcagtggtgtgtgattatggctcactgcagcctcaacctcccaggttcaagtgatcctcctacctcagcctccagagtaactgagactacaggagtatgccaccaaacctatctatttttttaaatttttttgcagaaatgggatcttgctatgtttcccaggctagtctcaaactccagggctcatgtgatgtgctctgctgggtgctatactgggctgacaatggtgaataacatctaattcttctccaaagagagcgctcttcaactgatgagggaaataaacaggagagcaggcagtgaatgatagagcagtatcagaggtgctaggttgaggatcttcacaagcttctaagtcaggacatcctaattcaaaccaggaaggatcaaagaagacagtaaagataatgaccacaagttgagtcttgctataagctgaatctggaagatagaagtgaaattgtccatgaaaaaggaagaaagaagaatgtcgaagaccaaaggggaaagagagtaagacaaggtaaatcaccttttgatatcgttgctgagttgtgtgaaaggctgtcaaagtgggcagaagtcatgttcagaagagttttacattcaaattaaggagtctctgttagacagctttaaatccatgtgtctaatatcttacaaagaccaaagactcatagtggatatttccctctatctaaaaataataaacttttctttccaaagggaaaaatttttacttatgaaaaatgtggtaaaatatagaataggaaattctgaaagatacaagttcttcttgaacaatgagcaatgtaaaaatgataaaattattgcatgatacaatcttttttaaaaaagagaaaacactgagcatcttttccttaagccccctttcataaaatctcatattwtgcccacttctccatcttaatgattgtggatttctttctcaagacctacttaatacatctcagttggaatttcgaaatgctggcaagtctttaaaaatagacagatgatgaccctaagacatttggaacttatcctaaaggctgaggcacagtagagaaaatatattgaataatatacaattttggtcaggaaatgaggaactgctaggttagaggccccattttctgtgtctggacactggagagaatgcttgtgtttggtcctccaattaagagctgcatgatgcctgtgccctgcaatgccaacacttattgggaacccataacctttgcttctccaacttctccagccaagattatgatgaaaaaagaggcaaaccacaattgccaagtctgttctcagcaattcgttcactggtctttcatcattaggcacattgcccctgtgtacctttggtcccaacgcataaagggatcttgcattgtaagcacatcatatgtttatttaaagaattttgaatctttgcagctcttattgactgttcagcagtgaaattagctgttgaaaagcatttgcactgggggtcgtttctggaaagaaaagaagtatttcttaccttcttctctaagactgcacattccttgggggtttacccatttgagactgcaagaagatgaaataactcacttttctctattaaaaggtgatctcaattgctatagagagaagaaataaacaattattaatattcctgtgtcagagagtgtttataaaagcaaactgtgaggttcgtaatctktttttagacaagaaaaagatttaaagaatgacttaaagtgatgattataagaaaataaggagaaaaaggagagagaggagaggttaataggtaggggaaattgattctagaccaagcacttaagaattctagttctatgtttgatttcctttttatacatcttgcactttgctctaaagcaaaggagttacaaaatttttaggcaaaattttctacccatgattagcgagcatttatagaaagaagcaataagttctttcagttgaatacacccagtacctctaaaaattaatgtaaagagcacatttcatggtcactaaaagaagggtgcaatttaatgtatgatgttaccatttattactaagaggacctgatacacaaaaatataaattactttttccatatcttctttcagcttcaaatgattttgattttttttttactttagatactcagagtagaatttataaagacatttggggagtatttctacctcaaaggaaaacaaaaatataatgacatttaaccatttcagatatttcatgatatgtagttagttttgtgtatgtttctactacattaaaatatccaatttattggttgtcttgaaaggcttttgttttctgcagagattggatttccaaatatattaaaataattgcagtatttatattgtccgttcttaggggctgtacttatattgcatttctttgcagagttattgatgatgtatccttgttctgcagtatggcacttggcaaaacattgcttcctagtttgaactctccaatgtaaccttcagggggaaatggttctagaataccattgcatcaactcttttagcaaattgcattattagacatccatttataacttatcctctaagtgatctcagtcgaatcatttgctgtcttggtttcacttctatgaaatattctagagcaaatgctgcccttgcttgtgtcataggactgcagtgttggatgccttctgtgaagttcatttagcccctcataatatgcattccatgtaactaggagggaattttctttgggtagatttctcagataagttgtagggggtggtgtgactggctaaagtacatcagtaagagatcattggcttgtgaggagtgcaaaaggcaggcagacaaggggaagaggaagtggaagaagccctacacatattgagcaccagtccacaccacactccccatgaagcacttttcatacattgcctcatgtagactttgagatgactctgaaatctgggtgttattagaggccagagatctcaaaaaacttgctctagacacttcatacaaccggtaaagggtagaattggcatttgacacaaatttgactgcctcctaaacttaatacattttctgcaaagttattggagacaatggagcatgaaatatttcttagtttcaggggttgaagtatcatctgcacttagttttcttctcaaataagataaactctaaacaacaataagaaaagtagatttgtgagttttgtacgaattggccagctattaatatcatttggcattctaaaggaagaacggctgaagtaaaccacaggtgcagatcaaatcttgatgtctgtttcactgcaggagacaaatagaatctctctttcttgtatgcttctgttatgttgagtctaaatctgaggtaatcatgatcatttcaacctgaggtatggtttactaaattaggagaaacatacaaaagtttgttgacttttaaactaaagaaggcaaaagccataagtgaaacaattcaagtagagtgctataatgtgactgtttctaatgacaacttgaattgattgtaaaataagtctggcagttaaaatgtattagtgttggctgagcatggtggctcacgcctataatcctagcaccttgggaggctgaggcgggcagatcatgaggtcaagagattgagaccatcctggccagcatggtgaaaccccgcctttactacagatacaaaaattagctgggcatggtggaggctgtgcttgtagtcccagctacttgggaggctgaggcagaagaattgcttgaatccaggaggcagaggttgtagtgaggtgagatcacgccactgcactccagtctggtgacagagtgagactgtctcaaaaaaaaaaaaaaaaacatatatgtgtgtgtgtgtgtgtgtgtgtgtgtgtgtgtgtgtgtgtgtgaaattatgacagaatttacctgtaaggtgttagtcatggaatactatgcagccataaaaaagaatgaaatcatgtcctttgtagcaacatggacgcagctggaggccattaccctcagtaaattgaggcagaaaaagaaaaccagataccacatgttctcacttacaagtgagagctgaactgagtatgcatgtacacaaagaagagagcaatagacactgaggcctacctgaggatggaggttgggaggaggatgagaatcaaaaaagctacctatccggtactatgctctctacctgcctgatgaaataatttgtataaccaaaccccagcaacatgcaatttacccatgtaacaaacctgcacatgtgcccctgaacctaaaagttggaaggaaaaaaaagggatagatgttagattattccaacctcagcattttaaataacctctatgactttcttagataagtaatagtaataccaaaataattagagagtggtagagttccatcaccaggtctttaccctcattttaggaataggttaaggcatcaagagataacgtaattaataaaggattatgctgtgatctgaaacacaagtacagtatttgtatttctgagctaagactaaagtccagatttctttcatttcggtgcttgttcgtttataccacactgccccaaaggacactaactgtaatagtactttgtcctgacatttaggacgcactcacacccttttgtccagatgtttctgtcttagatttccttactaaacactaggattgtgaaacctttcctttcctttctagggacaaaatggtattcactggcatatctagtttaatgctttgcgtacagggtgtgccacagacaattgggttaatggttgtaactggttaattgattgacacttaattttcagagttcgaccataactaaagagagatgagctccttgaggagcttcccactcccctagtcctcttctgctgaaaactactgggtcctcaatttttcctgaatacaccgctcatgtggccacccctaactgacccagttgaccatggatccaatttcagccactttgtggattggccaaaactctaaaaggaagcttaccatcaaaatttctgtccaaaaaggaatgatgaacaattatctaggccaactgaattcttctttactctggtactgaaaacatataaaagaaaggaggaaatctgagaccacaaggtgggaagggttataagaatttacagaagtcacaatgatgagaaagcagaagatatgaggtggagaaggtaatacatacatagcaaagaagttgatatcgactagatatggcagctgcagtgaggccagagatccactgaattgctgcatatcacaaaagtggagaaataataaacacatgattctgagggaataagttagcctgtatacttgaggtgccttagatcctatgcttttccagttctgcttcccaagttcatgtaccattccagcaaattccggaattcttttcatactattcattctacaataacttgacccctctttttgttgacgatgactttctgttgcttacaataaaaagaccccagtagctgggcacagtggctcatgcctgtaatcccagcactttaggaggctgaggtgggcaggtcgcctgrtgtcgggagtttcagaccagcctatccaacatggtaaaaccctgtctctactaaaaatacaaaaattagctggacatggtggtgtgcgcctgtagtcccagactcaggaggctgaggcaggagaatcagttgaacccaggaggcagaggttgcagtgaagccgagattactgttgattactgttacactccaacctgggtgagagagagactctgtctcaaaaaaaaaaaaaaaaaaaaaaaaaaaaagamcaaaacaaaaaaaagcctaaattatacaacaggatccatgggagaacatcttgatagctttttagcaggaacatcacattccaaatgcttgctagctattttctgagtatcagttatatttaccatgatcctgaggagcagaccctttattgtgtcccagttcagtttgcatcgtcttcatacagcataaggcaacagtgatagaaataatctctagagtaatctccaagtacctttccaaagctgctatgcctcaagtacttcctttaacctttaagcgtctgccttgcatacagtcctcttgggccactcttggcaaaatatttggaaggagatctggaacctgattatttctcaatgaaaaaataatttgcttttgcactgggaagcgacagtaatccaatataagcatgccattgaaaaccttcatgccctactatttcttttaggacttttgtgaaccctttctctttgatacattacctttggcaatcatggtattccaggacgtgccaatgaagttggctgaatctgaatggtcttggaagagtggtttgtggttggaatttctcttgcttgttgatatatgtactttccatgttggactttgtgcttatgtgaattctccacgtctcaaaggcattatgtctagcaagcaatttctcataaattcttatccatacagttattctatgagagcattgcaaatatagtcagattaggctttgatttgtttttcattctaaygctatctaacaaggggatgttctgatttgtgtagccctgtgcctccaagaagttaacggtaccagatacacagctcatttattttcattgtgcccatgtggttttctgaagtcacactttgtgttgttttacatatgggaaaatggaaacctggctaacttgtctttagtaagtgattggtggagaaattagtagaaactacatctccaaattcctgatctaggtaatgctgtttcaacaagctaagttgcatttgaattttgaaatacccactctagattgcaattaccaaatagttgttatgtacccaatcacaggatatgcttttgaaatttttttcattagtacatggaagagagagttttatattgtggtaggtagaaatgcccagacaagacaggactgagataaattaatggccagtccatttattttgataaacacaaataggactaatgcaccttgagctttaggaactagcagggcatttctagttgcagcatagtcacactaaggtgcaaagagtcaatggacaagcaaaaatgtgtaagaagaaaataagattctttgtttgttttctttatttgacatatttaaaagaaggcaaaagtgtatcttctaaaaagtacattttgtggtagacacttttcctctgctaaaccatatgacatcaagtggcatcccttttcttcctttgtggccattctaaccctgatcccagattggacaaggttgaaatatcagcatgaagtgaagttggttctggttaaacttttccaggattgtcccatcttccagtccttgtaaatgagtgtcatgctttgttgccaagtcaatgaggagacaatgttcacatggagacccttgggcacagatgaaactggaattccttctcacccatttcatacagatagtatgaaactcatttcaactgagaagtgaaaattctggttaaggaagaattggtacttgaaagttgttactttaaaaaattatcttgattcatggttttacaagtcagttataaatgttaatagcctccatcactgtcatgttagctgttgtttcagaaaagaaatacatattgtagtagttttaatagaaggagtaggacagtaaatgtaaatgtctgtcctaatggattgttttatacattagagaacaattttttaagtgatcgagtaaacaaagtccccctcctacctccatggtgattgtttctcatagatgaaaacagttttctcatcctgacgacgacaacaacttcttcttcttcttcttcctcctcttcttcttctttttttctctttctttcctctttatttttcttctttctttcctcctcctcctcctcttcttcttctgcttcttcttctgctgcttcttcttcttctccttcttcatcatcattatctcatcatcattatcatttcagtgaccagttagtgagcaccttcatgtccaagcactgtctggggtcttcacagatgttatcctaatcttcacaccagtttaatacaagtgtgttaatatatttgatatgagtgctaggatatagtatttggagatgagggaagctaagctcaaggtcacattctgctggaactggatttgacaccagagctgtctgattccaacacccacactcttccctctgccatatcctgtgggtgtgtatcaagttttctcccttgcctgtggataggttgcctattttttaaattaagctcactctttatttctttccttctccctcctccttccccaatttcccttttctccttctctttctttcatttttttcccaagatgatatttacctgcaatacactattgaaaatttctctatgcttctgccctgatctaatacaatttttatcaagggaaaaataacatttactaactaatacctttccctgtagaacctgatagaaaataaagcataaaatttaaagtttatgacacactgcaattcatccaagggcgtctaaatgttcaaagaggcacaagagagagataatttgcttttaaaagaaaatgaggccaggctcagtggctcatacctgtaatccaagcactttgagaggctgaggtgagaggattgcttgaggccaggagttcaagaccagcctgagcaacatagtgagatcccatctcttaaaaaaaaataaaaaattagccagctgtctatttaaaacaagaaagaaagaaacagaaaatgggaggaattcaacttttgattagattgtattggatttctgaaaggaaaagggggtaccaaaaaacagagaatttgttgattaagtagtgtttaagagcagaaatgtctgatgttcagtttaaagatgcctgcactgctgtgatgtaacctctgcttgcctgatactgaactctaaccatgtgtatcacatcctagacaggggagggaatggaggataattgacaagaacagcttttgatgttaaaactaggagccaaatgcaggcagggaatactgtgggaagagagcaactagagttgaaaggatggaattttccataagcaatacaaagatttttgatacctgactcctacttaaaattaattcgactagaaagactcatctttttctgaaaaactttctaatcatatatcacttattttagttccacatttgaaagcactgttgccacaaaatcacctattcttttactgattttattaattaataaaagacattgtgtaggacagtatatttgtcataattatgggcagatataagcattagctccattgcaaaataggattaaaactgaatgtacagtgttgtcaagtatgaaatatttttcccagaataaatgagtagagaagcatttaaagtctccaaaaactccaaggggcctaagtgggctctcttccaaaaaaataataataacaagttatgatcatattaccctgaaatagattcaattacccaaacaattagtcagctaacaaatatttatcaaggctcactcttctaactgatctgggatacagaaggattgtaagaattagtatcctccctaatggagttttcattctagtatgagagacaaaagtaacacttaaaagctaaaattgaatgagttagttacaaagtctgtggggttgactcgagtagagggtggttgatcagtgtaggtttaatgaaattaaaatgagtaagattctataaatgcaagactggccagagaaagtggggagctctggggccagaacagcagaggaccaaaggcatcctacacagccaattaaggaattttcctactgmagcatggggtccagggagcttcatttgtaatcccttgttctgctttgtttcattcttggactctaatatggtttgactgtgtcctcacttgaatctcaccttgagttataacaatccccacgtgtcaaggttggtgccaggtggagatgattgaatcatgggggcagtttcccccatactgttctcctggtaagtaaataagtctcattagatttgatggttttataaaaggcagttcccctgcacaagctctcttccccaccactgtgtaagacatcccttttctcttccttcatcttccattttgaatgtgaggcctccccagccaatgtggaactgtgagtccattaagtctctttcctttataaattgcccagtctcaggtgtgtctttatcagcagcatgagaatggactaatacagactccatcacagacctttgggctaaggactttacctctaggcacctgccctattacttctattaaatggtgtaaacacagtttgctcacccatgcaattgccttactgtgattcatcttgaagtctagcctgatgacagggatactatgcaccccacaaccaaccctactgagtaattggctccattaaaacaagagagaattgtgagataatctggatagagttagagttcacaccaaacatagagtttccaatttaatggattagtttcatttttgcaacattcagtactgataggatgggtcaattttggcagggcctagttgccatcttaaagcgaggtacggggtgctatttagagcactttgcagcaacaaagaggacaaggtttgaggataattctaatagctcttatacaaagatattgaaccaagtaaatttataatatgtgggtctgcaaagtattcatgtttcttgagaggagtgcttcagattgagagacgggagcaatctgtaaagaaggaacccaatggatggacactggggaatgaatatcaaggacacagttaggtatgaatttaagctagatgttcacttaggtaactgtagcctggagtggaatgacaggttagaagaagtctcctaggctgggtgcagtggttcatacctgcaattccagcactttgggaagccgaggtgggaggatcacttcaggacaggagttcaagaccagcctgggtaacataataagatcctgtctctacataaaatttaaaaagttagttgggcatggtggcatgtgcctatagtaccagctactcaggaggctgaggcaggaggatctcttgagccaaagaggtcaaggctgtagtgaactatgattgtgccattgtactccagcctgggtgacagagcaatactctgtctcaaaaaaaaaaaaaaaaaaaaaaaaaggacttcaaatagcttacctatgaagaagctgcttggtaataccttaaatttcccttctatgcttttacacagaaccctaaccttgcagttgaggacttgagtcatctcacaattcttttgggtaaaaaaaatgtaaactactgtgacccaactttctttacagctgggaaggcctctatttgattgaaaatataaattaagatactaggttttaagttaaaatattaaattacctctagcttttaaaaatcataaagatctttctttaactaacagtagagggatctagtgtttcaagtattgaattggtttaactgagcaatttctgaatgtcaaagcaacagattctctaataacatcttttgtttttctaaagtttattcccatattatgttatattatcagagagccatgtaaggggactatcttactttatatccccatagaatttccttcccagagttacaatttaacattttgtcctcagcttttttatagaggtcaatataagaaatagcacaggaagaatctcttctcccctctgccctttactctgggcagaattaatcctttacttgtctatgtatatactgtgatttatatatactgctatggtagcacttaggtaataatattattgtaaggaattttgctgtctgagataaatcttccctatattctcccctttgttttactccaaaggactataatcctgcagagtttttcactaatgaatttaggcattatttttctctaaaagaaagatcacactgaaaattatataaaataggctgttttcctgggatacccttgtggcttgttagaacacccggagtcagctggactggactgccactcttcttcacttactttataggcagatgctattccttttagagactgtctctgaaagtgaggaccctgggttatgtctgatcgttgggcggggagggggctttaaggttctaatttttgtatgtgtcctatttccatgtcttgtttcccagataaactatttccttctatgtctctgctttcctgaagacaaaggtacctttttctcagcagtggagttggagaggaaacagattcaggaagagtccaatattactaccattattgcaattgcgtagtagtacatgccaaattcaccctgtcttttcattttacttacctttctcttgtcccacatgcttttattcttggcatgcttacctacaaaattatcctttttttctatttccgtattccctatgccctgtagtcttctttcaaagcccctttgaaatgctatcatgaaagayggatttcttttctcagtgctgtgagcacctccatctcctcttctcttctttcacggtgcccatttcttcttcatctcatcaagtatgcagtcctttcttcgtctgcactgttatgtacctccttccacctttgtttcttccaaacttgtatttcttttgtctttccatttaacaggcctcatttcttttatcttaggaatctattcataaaatttatacagtctttaaggtgcaaacaccttgaaggtagagaccatattatttctatgttctttatattggcactccaattaaacaaaagtctatgtccagttgaagtctggaagcctgataagcacactgaagtaaaagtcgcaatacacatgaatgactgaaagtaggttttgttaccagtggaaaagacatttgtgagaacaaaatgacacataaagaggaagcaagtgattactgacttactggaaatcccaggccgggcacggaggytcattcctgtaatcccaacactttgggaggctgagatgaggggcttacctgagctcaggagtctaagaccagcctgagtaacaagtgagaccctcttctctaccaaaaaataatttaaaaaaaattagccaggtatggtagcccatgcccatgcctgtggcctcagctactcaggaggctgaagcaagaaaattgcttgagctggagaggtcttccagcacctgaaagacagagaaagaccctgtcttcaaagaaaagaaaagaaaagaaaacccatacatttagctcaattgactaaaagcctaaatgaaaaatatatatctttcagcttaaagggttggttggattgatttgttgagtaaggtattactatttggacaattgtaaaaaggacctgtgaaagccatattttggcttggacaagctcacccaccccatgccccatctctactaagggggggtgggattcactgtcaaaagagttcttctctttaaattctatacaataggtacagtaattatatctaattgcatttgaaacacaatagttattaaggcaaacgtttctagactagtttcattattaaataaaaattgaaactgagagtttttcccatattggtaaatattgwtttaattttttaattgaatgggaataatatgggcatttttttatcatttgcccaaaatattttaagaaaatactatatagtgtaaccttttttttttttttttactatgaaggcattaattttgttttatttttagtacttgcttccagttcacttttcaaagtgtcctttaggcttgttagtttcaaaggaaataatatatttccttttgacttaaaatgcctatgctatcattagatattaatagtagaagtaacagcaggattgcctggcacaaatttgtcctgtccttcttctggctaggcaatagggtgcaaatgttccttgctgtgcttttgatggtgaaatagaaataacgcttcacattttataacacattatatttcataaagctctttcacattcatcacttcatttaatcatcaaaaacaattctgcaaactgatattatttttcacatttaagtgtgagaatattgatgctcaaggaagcaatgatttggctgaggacccaaagtgagtgtcagtgccaagacttaaatctatttcttctcactcactccagagtccttcccacatcatcacactgtctccttctactgtgctttgctctaacctgctgaactaactagcaagtgtctttagcatactacattagatagctaagacttactgaatgcctactgtatgccaaatcctgtcttaagaacttacatgtgttacctaattcaatccttgcaacccatgtatgataggtaatattattatctccatctcgcaaataaggaaacatagaatttaaataacttgctcaggaaggcatagccaataaatggaataagtaagtctcaaatctggacagtctatcttgagaaatgcatgcttaatcaccatcctctattgcctcttaaataatcaaagcccgtaaagattttataaatgacttttctcatgaataatagggcctggggtgagtttctcaatatcacttayggcaataagaatttcagcaatcataatcttggtgcattttccaaaaaggatggctccccattgggtaacacaaggtgaaatgtgtattctgttagaaatttttgattccagcctagggaggtatcaagaataatgctgttgccataaagatataagtcttgagacaaacactggagaggttcagtcattcaatcaactatacatatattactgaacattttttatgttcaaatgctgtgctaagtatctgaataatattcacatgaagctgaaaatctatcaaaaatacatttgaatacagatacttggtaaaatctctaaaatgcacaaagcttcatggacacatgaaatttctttactatggagaaatcaaggaaggtttaataaaagtagtaacattagagctaatctttgggtaaagaagaggaaaagacaaattgtagtgcatgctgtaactgtatataggttctttggagatagctcattgaatgcaaactttcagaactcacttcatgagtcaataggaactttacacaatggtgagaataaagtgcatcctttcaaagcacactgtccatggcgtgagagtaaccaccacactgacatttgttgaagaaaggttctcctgggttctccccactctaccctccttggatgccaattaggcaccttaggaaggacaagtgtcttccctgtcccaaagaattgatttttatagatatttatatctacttttgtgaacatgcaatgttcattttgattattattaaatcaatgtaaattctgaatgaatttctctgacttttactttgcttattaagttgaagactcaagggcaatgcagatgagaatttcagattcttcctttgagaggatttttggtcagtggctctttaagaagacccaaagcaggttgggtatacttcgtaaaatcagatacttggtatatagttcttttttttttcttttctttttttggtaacatcaccacgaggatttctttgctgaaatgcactgaccttctgtaaaaattaacactggaagtattttccaatggaaattgactaataaagaaatcaataatgaaggaatatttttagactggcaagaatcatgatgacactgttaagaagaaaacattgtacatatttaatatgtttaaattccagatcctcaatattatgattaagaatttaatgatttttgtttataattccttctcattgtgtgcccacatcatacttagcttaaattatgtatctaaatatgtcttctctataaagtttcttgtggtcagaatcaagtggtccactagtttcatttagcagtagatgtatatattttgacacataccaaagaagtgcagctcagtacccaaaagatgtactaactgaaaactttagttcatgtaatatgcccggcattcaccctcgcggaatttagacaggagggattgtggcctgtatgtttgacttctggaacttaccttagtaaaattcaaaaaacaggttcattagtaatttcttcaaagaaatctgcttcaatttattcagatgttttgtagtctctactttgtattaaatataaagcactgagttaaagaggtaaaaatatcaaaatgaacaggatagtctctctcctctgggatcttataatcatgtaaagaaacagatatgtaaaaactgtaaaaaagatatgtacaatataattataatataggaaaattaaaggccatacattttgtaaataaacagctatgggaacaaaaaaatgtgcatttttttttctaattggcaaagtctaaatgggattgtggaggagcagtttgtatttaagcctgcaattgaactacatgtattatttttaaaactggagatttgaagggaacactggtggcaaatagaattgtatgaacaaaggaacagagatttggaaaggcagatggatgtcagcatggctagaggacaggtacacagctgatggggcagaaggtagctatgaaaggtttgcagaagtcagattgtcagtttcttttaaagcctgctaaatgtgtacactttattgtgtaaacagtggcaaacagtaaaggttttgaactgtaatgatgtagtggtctgggctaaactattcagagcaagcattttaggttacagtaactgaactgtgggtttttgtttacatgtatccagagttgttccctacctttgcaaggtcagtgtctcagtgatgtgccttaaataccttgtccttgaaatagaacctcaacatcttcaccttgttctttttttttaaaagaccgtgtcttactctatctacaggcatgcaccaccatgcctggctaatattttatatatttttaaagatgggacctcactctcttgcccaggctgatcccaaactcctggcctcaagcaatcctcccacctcagccccccaaagtactgggattacaggcctgagccaccatgcacagacttatccctctcttaaaaaaatttgttttcaacaaattcatatgagtaagattaagaagaaatggtacaaccagacataagctgaaaagcaaaagtctcctttcctactttgtttattttgcttcccctttcagaggaaactacatttgatcattaaaccaatacatcatttatattcattttttcaaaatatattaggttggtgcaacagtgattgaagttttgtcattgaaagtaatggcaaaaaccacacttttgcacctacctaatataaaacttcatttttgttttgtctttcatattgatgaaccatcatytgtttatttttttggatattggattgccttcattgttttcactattataaatacccctattacacatacaaaatcaaaataccatttttgccttggctttttaagaaaataaacgttgattttaaaaacaatttcagatatacagaaaaattgtgaagatactacagtgaattctcatttccctctaccatgttccccctattatgaacatcttatattagtgtggtagatttgttacaataagtgagtaaatatgaatactaattattttttattgatatctgatattatttggctctgtgtccccactaacatctcaccttgaattgtaataatccccacatatcatgggagggacccagtgggagataatttaaccatgggggtgggtttttcccctgctattctagtgatagtgaataagtctcatgagatctgatggttttataaaggggagttcccctgcacatgctctcttgcctgccaccgtgtaagacatgactttgttccccctttgccttctgccatgattgtgaggcctccagagccatgtggaactgtgagtctattagacctctttcctttataaattacccagtcttaggtaagtctttattggcagcatgagaaaggactaatacaatatcaatagatgttgatatcaattatttttatcataatttattcagattttcttagttttcacctttgtcttccaggagcccatcctggataccacactacatttattcattatggctccttaggttccacttagctgcaatgttttctcagacttcctttgttttggacagccttgtcaactttgagtaatactagcagggatactgatgttttcctaagtaccagactggcgttctaggtttagtaaggaagttcacagaggtaaagtgctatgcatgatatcaagtatacatattatcaacatgactttacaccattgatgttgaccttgatcactgggctgaggtagtgttgtcagattactccgcctgaacatcattgacttttcccctttccattctgtactgtttgggaggagctcattatacacagttcacacttaaggagtcaggaattactgtccacccactggagggtgaaatatctacataaattaattgaatttttttttcttgagatgaagtcttactctgtgggccatgctggagtgcagtagcacgatctcagctcactacaacctctgcctcccaggttcaagtgattctcctgcctcagtctcttgagtagctgggattacaagcacatgccaccacgcccagcaaatttttgtatttttagtagagacagggtgtcaccatattggcaaggctggtctctaactcctgacctcaagtgatcctcccacctcagcctcccaaagtgctgggattacaggcgtgagccaccatgcctggatggaattcttttgtatggcagatctatttcttctatcccatttatttatttattaattcatttatttacatcaatataggcttatggatattcattttatactttgggttaccatccaatatgacttcactttgttgcttaaattgttccagctttggccactgacttctgtgcccctctgacgtttcccatcagtgtgggatttttttttttaagcacttccttactttctggaacgacatgattctccaggcttatcttgcatattttctgcttcaacattaggcaaccagttcttcaaggagctatgactcttttaattggggaacagaacaaaagccaagacctgagtgctaagtgtgattgttactattggggtgcccttgcttctagagcttctcagctgataaagtaaagaaatttatgtgtgtatactaacttgtgcctgcgcacctatctataaatatttctatatgtaaacttctgtgtctacattaagctaaacatgagtacattttggtgtttccaagtctaatatattaccacctggttagtctagcctattccccttgtttttttctgtaaaatcctacaccaaagtgagaaacatggcttctaccttcctctatccattcacataattattaaattctattgtatgcttgtagctgaacaaaatttttaacccatattgctgtaggaaagacactttatcaactagagagtttgagtttatgtgcagttcctcttccttttagacttacagactccactcatttccaaaattactgttaaccacttttaccttcagtgaggttgtagtgtacatttgtgatayagttatattcttttggaacagcctgcattccatcctgtgataaatatgtattgcaaactctaaagaaacctttttaaaatgactaaaaagaagattaaagatgcagtgatgcgggaaatcagtaaggatataaaatcagtaatttgacctgaacagcactatcaatcaatttgttctaattgacatgtatagactattccatccaacaacagcagtatacacattctgctcaacctcacctggaacattcatcaagtagaccatattctgggccataacatttatcttaacaaattcaaaagcgtggcaatcactttgaggaacttttccagagggtataaggaaaggacaaacaaatgaaatatagaaatgatagaaaaagtgaaataaagagaagacattgtaatgttaatgtccataaaatagaaatacaagaagcattaaaaaataaataaatcaaggatagaaaatatttgaagaatattgtattcaaatatatcttataatttttgaaattataaaagcattaagaacccaaatttgagggtttcataaatggttaacaaaataaagaaaataatcctttacctagctacattattgcaaattttaggacataaaaggcaaagagaacaaaacaaaacattcaaggagggaaaaagaaacaagtattcaattgttatatttctcaccagttatggtggatacatgaagataatacgttactaaagaaaaagtgctttaaacctgggaatttatattttattaaaatataaaatattatttaaatgtgaaaatgaaacaaatttatttttagtttgaccacttaagatgtgctttgaaaataccattgaagatgggatatccataaaatggaatattattcagcaataaaaactcatgagttatcaagccacaagaaacatggaagaaccttaaatatacattcctaagtggcagaagccagtctgaaaaggctgtatgattgcagccccacgaccttctgggaaagggaagaccatagagacaataaaaaagatcagtggttgtcaaggattcagggactggttgaggatggagagggcagtggatggggagggaaatgggtagaacacagggcatattgagggcagtgaaactattttgtatgagactgttatggtggatacattgcatcatgcatttgtgaaaactcataaaagtgcacaacaccgagagtgaaatctaatgtaaactatgacctttaattagtaataatgtatcagtgttggttcagcacttgtcacaagtgcaccacactaatgcaagatgtgaataatagggaaaaactcgggagggtgggggctgggggaaggtgtagaaggaatacatgagaactctgtgcttttggttcaacttttctataaatctaatactgtttaaaaaattaaagtctgttgattaaaaaaaattacaccccagaaagaaaatatatccaggagaacccaggaaaatatgggaagtatggatgagaaaactatcaaagctatcagtaaggtatattacttataaataaacaagaaacaaaagagaaaaagcattcacaaaacaatccagactaacaattctcaaagacagaaatgtggtgtggtgggaaaaatgggatggagagtgtgaacaaagtcatgatgagacctcacagaggcaaaaatgtactaggatacttgtcttgggggcaatataaaatcatgtatataatttaagggtaattaatacaagtgttcatttaatacagtgggaataactaaggaaaaatagaatttgagaatataattctcaaaccagaagaagaaaatttggtatgaccaatgaaaggaagaaaagaaaagaaggaaaaaaagaaaggaagaaaacatatagagaaggaatagaaagggaaagaggaagaaataaaggaaaaagggaagggaggaagaaagaagggagggaggttggaagagaggaaggaaggagggagggagagagggaaagccaaaacaggcgaggaatgatgagaaggatgggtagctgttctgtggattgtgtgagttaaggggaaggaagtggtgggacttaacatcagctccatatgctacagagtcaagtatcctcacatattcttacattttccctgaagttatatattgagagccagtggaagacatcgtagaaattccctggtctattttgtgaatgtgtcttgtagtacatagataattacatgtgagccattcctataaaaaggtttagattggtcaaggatgaaagaaaaagagacttgcaggtggaaaacaaaaagggcaataaattaaatctttcaaaataataattgctgaaaaatagtcatcttaagaacctcatataactactagtttaaaatattgccatccagttattgaaaaaagcaatttttcacatcaagaatttttatttatcttaaaatatttcagaggcaattggtgttatgctttagacacttgactgacagtaaaagtttactataataattcaaatgcctcttcaaagtggatgaacagaaacaaaacgttcagagaggtgagtgttaaattattattatttagtgggaaaatgacctgaactattttctttggttgctgttacataatccataatctgatatcagttccattttgttgtttgtatttgtgcttgaactttcaatacaatagaggtcactaatggaagcctaaaaaagaatttttatttgacttttggttcattagaagtttctttgttctagttattttccttagcagagtgaatttctctcactttctcactatttgtccaatttactacctaagcctggatgtttgtcttttcatactctggaaacatggacaaagacaaaacatagggagtttcgaggcattattcaataactacctagagaataatggctctattttatatgatctaacttggtcacttgaatgggtcatatttctccaatattcacagaaccacctaagttgtttttggttgtgtggacatagatcagattgcctttgaatcatgatttgtagatgtaaacactatttattagttgtaaaaactttatattatctttaacagcctggccaaaaggtcattattgtttaggccttctgccttccagaaagagtatgactaaaacagatgtattgggcagaatttccagaaataccccaccacccccaatttcacagggctaatatccagaatctgtgaatgtgatgtcttttcattcccatgattgtcttatgtgatatgacgtagttgaccctgaaagggtagggtattcctggcagacctaatctaatcacagaagctgttcaaagcagagaaatttctcgtgctagtgacagaagacgaaagcatcagggaaagtcagaggaattcaaagtgtataaaggacttgagctgttgctggtttgaatacagaggagccacatgagaaggaaggtgggtagccatgggttgctgagagagagattcacagctgagcatcagcaaaggaacctggagctcagacctagagccacaaagaactggattctgccaacaacctgaatgatcttgaaagtggtttcttcccccacattctccagattagagcccagtaagccatcaccttgactttgaccttgtgataacttgaccaaacctagctaagctggccaggacttctgacccacagaactgtgaaataatacatgggtgttgttttaagccattgagctctggtaatcagtaatatagaggcagacaataaatatagcatctaaaaccagtagtgtttattttgagatgtcaaagaggatcccattctggtgtttgatatttcagagtgccaggccatttttcctcacatcccactgacattcctcttgttttgatttaaatgaatagtctcccttagatgtcccagacaggattataagtctctttccttaaaagtttcagttgttaagatatgtagcataaaattgtatactataatggatcttgtaaatctaaccatttgctaaggtaacacaggttgtaggaagcaaatctggtactagaagccaagatgaaggattttcaacctagtgacctttctactcaaaagccatactggctctgaccttcatattttaattgatcaggcaaataatctcaaatcctccaactttgtttgattatttggctaattctgctcagaatcctctctaaatatctactggaggcagggacattaactgaatttgaaaagcaatattatggtaagactctctctaataataccataaaataccatagcaaggttgtttttaacagataattaaatgaagtccaaaggaaataactagcttgcccaaggttactctttgcaattgagaaaactgaggcttgaataggtgtaattattcattcaaatgtcctcggccagttcatggcagagatagaaagtcgatccacatctcttgatttccaattctttttttacactgagctatgtcaatatgtcaattctatagggtttgccctcagattagtttgagaaataaagtatattcacagcctctgtgttttcagtgtactaccagctgggatatctatgacttagttccaagctgtgatattctctgggactacaaatttttaagagccattttaaaattggctagaaggcaaatctagggtgcccataatgactgtacccagccctgctatgagtgactgcactgtgatttattccctactcagtgcccatcccccactccaaagccctacaggatttaggaaaaactgctggaagaaatgctacatcatgaaagcttaaaaaggctcagggaacaccacacttgaatcagtataggtgggactggtatatttcttttgctatttcattatccattttgcagttcttataaaaaatgagtctgttgatgtagtcttctgaagcattaagatatatgctatttctgcagtgaacaggctgcttagtgaagaagagtgtcggctcacttttgttctttcatatatttattagagtacgctttcccagagtgtcgattgcatgactttattgaagctagtttgaactcagactttcccccactgaatctgagatccactgaggcccagacaccaaggagctgttacacatgtataactattccattcacacctcttcaggagtttcaaacaagtttaattataagagaaacaaaagaaagcacttcttctttgccactgctaggaaaaaaaattgctttgcttggaaatcaattcattgtaagctttaatctgcctagttcggtttctcagaatgaatatttcaaatattaaatattttcttgagtagaatgtatagtacatattttatactaatatccatgtgtgtgttagacaattaagaagactggagtgttttccaaaaacttgaaaagttttcggtgactcgtaatacagaagtgacatttttatttgagaacaatttaccagattatgtcaagttcattattggtatgatactaattatccttaggataaattggaaaggggaaccctctgctagttttctgaagagctgcgtaagcctgatgaaatgtcttttctctttctgtgactcaaagctccagaaaaatctgcaaagttgaatatcacttgtgcctgctaatcttgtgtcatagttattttctatcactgtcataatgtcagagaagcactgggaaaatctgcacatcactcatctctccttcttcacccttatccaggtatatccacatatatccaaacatccagaaggtcacaggtgggatatttttgaagatgtactcacttcagcacaggtgaacctgttgatgacttccaggtctaaatatggtgaccttagtcacactggttatttttagggagcttcctctgactcttttataaactcaagatgataaatgcaatctacctgtaagattcttgagaaatttgtgttgtataatatgaccgtatatgatcccagtagttgtgtggaacttgataggaaccacagtaagtatcacctctccttgcttccatcattcccctactccaacagtttcatcttcctcttctgtttctagtgaataaaacatagtctgctgattttaaggtatattccattcccagttgtatacacaatggttaactttacattcgtgcaatcagtcagtcaacatttgagtgtgtactctatgtcagatgctgttttaggtgctaggggcccagcagtgaacaaaacaggccattgctgtgctggaagtaaaattctagttgggggagacataaaataaggaaataaataagtatataatataaggtaatatatacaaatgaaaaaaataaagcaggaaagagggtagggttttggggggaagaggatgttaaaaagttctaatggtctaggtatggctcattgacatagtgacctttgagcaaaatcgtgaaggtgaaggagctttactctttgaatcaggatgtcaggtcttagtttagactcttcagactagatcttagccattgtttatagatttgcttaaatgtctaattctttttcagctgattatgttggagtttattgttcctaatgaccaatatgctctaccaatgtcagaggcctgattgacttttgagggacaatgactgctccagtttatgcactttctctccccccagccctcccatccctcccatcctcctctgcctaccctccccaccccactcactttttggggttcctttgtcagctgtgtattatggcaaggatcgacattttcttgacattcattgtagagaaggtgatgtaatctctccttggagggtggtcacctgctgcttgcaggctgagctaaaagcagattctctcaatgacaggtatgactgcatttcctgggcaccttcagcaaacaaggctcttgcaacaatagcttgcgtcttattcttaattacttcataccccaaattaggtgggctaaatatctttttgttgtcacagaatggaaagcacatcataattagtgtaaaacaaatatcctcatagggtccaacatgcagtatcctaaaagaaaacgaagtaaacaatttatgtattttgtaatatacatggaatatgccattaggttgttttgcaaacccatgtaggtgatcctggtagattagatttacaatatatctttcctttcacttcattctctccatcctctatccattaatttttcttatatctagaaatagggcactaaagaaaactacagtatacagttcctgctttctctgaaatcaactattaacttcaggcaagtggaacacatacttggtacattacttttttttaaatccctgtattgcataatagaagagaatggtaatttttatcatgccattaatgtgattcctttctttattgcttaaagtgtcaatcagtcaaattgaaatgggttattactctgttatcttcttcattttaattatttggctctcccagcattacccttcattacctgttctccagaggatttgttttatctgaaaataatttactgcttaacatcgatgcatttttctgatatcgttaggtgggcctggtgttacatttagagagttaccgtcatcagagtaagaggaaatatatacagtgttttatcttgcagaacttaatgtaccaaatctgatgtcctataatgtttcagagggatgatacaaatcatttgcaactagaagctgaatattcagccttgtcacaagaattctcccttattcaattagattttttaggtgtttgctttaaaaagtaatatcagattagtaatggggaagcaatctttgaaatcattggtgggccaaaccatgataataagatacaaaagagaaatgaatggtgggaaatggcagacacattacacataaacattgttttgttatggcaaatctctacggcttctcaccacgatgtcagtacggaagtttgaaagaaaaatgtatgcgtctcccgtagagcccatgaacttgttttcttttgcatattatagaatctgcaggtatttttcaaatgaggaccacaaacattcaagtattaggttttcttacaatgacagccaatttagcaagcccaaggttttagagcatccttcaagaggcwggttccatttgcacgttcatgttcaattcgcaaagcaacagcagcagcctttacgtatcccacgattaacacttcaacctccagcccattttgtaaggttaggcattcatcaaaatgtcagaatgattacagtacagatctaaaatcccttttgtcagacactggactttaatccgctcttttctgtagtcacgtcctgtcacttttgcagctgacaattattgtttttggtcaaaaaattgtaccttgcaatcaaaatggcttgttatccaaattgatctctgatgctacaaaatgttgtttgtggacaattctcctgagcaccactctccctctcctccagagtttacagttgaaatggaagcaatagaaagtcaggagaacagggtggggctgaggcatgcctggtcttttcactgctaggcttggatgcctaggaaatttacctggaggcttctgagtaactgaacctctaaaagatattaaacgagactttttcactattttattcatagtttgtgcttacttttaagtgagcttttgttttggaattaaaccctgacagtcagtggcagctagaatcgccacctgtcaaaagtaaggtttccagtaaacaaaatatttacatatatcaagtgtgagagagactggggaaaaatttaatgggcaaacagaaattcatagaaggctacaaagtctttcttgaccagtctcacttgtaggtcttaagcctaagatgccatattacaggtggatcagcttcgggaggaaagcaagagctttctattggaagcaagcaaacccctctttgtgagtttctttgcatttgaggttctataaattttggagctaaaacagttagtcccttatttttgtttcactgaagctgctgaatgctaataggttattgatgatggttttatttgccagccatgaaaaatgcttggacaacaggacatgcatgacagttaatctttgtagagagaagatgagcatcagtggctgaattaggtgcggagggttgcagatgatatttaggaacacagtgacatcaagggagagggtagcccatggaactgctggccataaatagttttaggcatactaaaaatatcaggagaggataggagagactatgtggaattgctttacaagaatggcagcttcttaagaattataatgagatcagaaggtacaatgcttttcagtacttagaggtttttttctagatggaaataagcaaaagtagagaattaccagggtttacattttgtctccatcatttatagctaattgaacatgggagaaaacgtagcttccttctaaggctcagcttcctcaactggaaaattggactaaaaaagaaccatacttcagagttgttaacaggattaaatgagataatatatgtcaagtgcctagctcaatgtttggcacctcagcacatgctccagaagtggtatcaattattattacataacagagataatatttggtgggctatgtgtatttgtgagtgagagggagaaagataactgttttttttacgcatttttgtgaatgtataactttctcccaactcagctgaagcatccaccatggagagaagtgcttcaggactgttaccagagaaattgaatgagaaagagatgaaaccattttttaacatccctaatgggaattttcagtgaatggctagacagtaggcataaaagccaaactgtcatcagggaagagtctttatacaatcaattatcaagatgcctgatggataaactagaccacaagtcctgcaggaggacttgctgggatggataaagtaaggaggcagtaggtcatcccttctgttctgaggaatgtgagaggaggacaggaaggtaggaagggcaggagagtcttcctttgcagactgtatccaagactggaaagaaattttaaattagtaaaatgagataccagcagcaggaagaggaaccactttgctgaccaaccctatacccactgggtaaagggagacagagcatcaaagtgatcccagtgatgtcatgtagataggcacagagaaaatgttggtgcttagctttcttgagcatgcctgctaataactggcatggatgggactgaaaagttcctgggttgcctaaataaaatacaaaggtgataactgctaagctgtgccagtatgaaatgaaggcaggccaaggcctccacagagaaccaccagccctgattaaactataagagactggccaccagattccagcatcagatcccaggtagggcgccatacaggagagaacctacaccagggactggcatgatctcagactcccatagatttggaaaccctgtctgtccactaccctatcatctcaaaactcactacattctgtacactcagtgcaatctttgaggggaacagagaaaagagagaaaatgggaaatgatgggattaagctaaactgacatgatagactaatcctaatcctattccctccctattcacctctgtcatcaccagtgccacacagaaggtgggagtcatgagaaagacacaatgcattgtacataaaaggaaaaaagctgtgtcttcaccaactcgaaataggaaaaattgtgaccctgtgatgacaactattacagctgtcataataaaatcaagatgatggctgtatttctcaggcctcacatcaccttttcttttacaaattatttgaaatttaaagtagttttttctaattctgtgaagaaagtcaatggtagcttgatggggatagcattgaatctataaattactttgggcagtatggccattttcatgatattgactcttcctatctatgagcatgggatgtttttccatttgtttgtgtcctcttttatttccttgagcagtggtttgtagttctccttgaagaggttcttcacgtcccttgtaagttgtattcctaggtattttattctctttgaagcaattatgaatgggagctcactcatgatttggctctgtttgtctcttattggtatataggaatgcttgtgatttttgcacattgattttgtatcctgagactttgctgaagctgcttatcagcttaaggagattttggtctgagatgaaaaattcatcctgctaaaaatgcttgatctggtaagccaagtgctagagagactagaggagccaaggaacacgtaggtagggtgagataacagaagaatacccaagctgaattgaaaggaggaggtgcaaagaagcttgtgcattggattaggaaaaaatatagactttgaactcacaaggacttgatttttttccaatttgtcgtctcactctctgcataacctctattatgagttgaattttgagccccccaaccccccccaaaaaaagatgttgaagtcttaaatcccaacacctgtgaatgtgaccttaattggaaataaggtctttgcagatgatcatcttaagatgaggtgattaggatatatcctaataccacatgaatgtatctgtgtataaaggggaaatctgaacacagagacagacaagtccaaagaggatgaaggcagtgatcaaggtgatccagctacaagccaaggaacaccaaagattgccagcaaatcaacagaagccaggagagaggcctgaacagattctccctcacagcatgcaaaaggaacgaaccctgccaacaccttgatttcagacttctgacctctagagctgcaggatgataaatttctgttgtttaggccacccagtctgtagtgcttgtaatgtcagccccagcaaacaaatacagcctctcaactatgtctcatcggtaaattaattatttctccccaactcataccataaaatattttagacagcttgcacaagcccccaaacaaaaaaactgtgatgaaatggctaaatagtgtagtagccatggygtatacgaatataaacagaaacatcgtaacaggaaaaaataagaaagtccattagatgcagttgagcttccagcttgtctcttagtttcctggaaaccaaagtgaaaggaggtacctgtttggtcagaaaagttttagtattacaaaggaaatagcattgtatttctttaggggaagcaaaaactttttcttagccctaaattctacaggcagtgctgaattgctcagtaaacaatgcacttaatgatatttccttggcaaatttggtgaattatccatacactggtgtgtatgtataacatggtagtgcaacccccaacctgaaggtgacacttgtgcgcacgtaaatctctatttcttagagatgtcaaatcaaatcttataaacataagaaagctacataagcatcacaaaaaattacaaacagctatgcctcattttcataagtgatgtcctgactctatctgatctagttttcatgtaagtcctttgccactttacatctatcctcaaaagcctaacggaatctggctggataccccaggtgcttcctcaacgtagaagttttctcttgtttktttttttttttattctgagttattttgaatatatcagtcaattttaatctaaacttgcattatgttttcaaatacaatataagaatttaattaaaaacaatgcttcactgacagcagctctacaattctgtatttgacattgtagtacaacatgcaaaggcatgtattgaggtcagtctgaaatgaaacacttagcctctatattttttggaaaaacaaatccaaaatatgaaacattcagataggtaggcataacattcagatgtccagtgatggaggtcttgctttgaggggcaggctgtttcaggtataaataaatctctcaaagtctatttaggaaaaagatatatatatattcctgcaacttcttttgtttatttttattttttgtagagatggggtcttgctatgttgcccaggctgttctcgaattcctcacctcaagcaaccctcctgcctcagtctgccaaagtgctgggattacaggtctgtgccactgtgactggcctctgtaacttcttaattctgtctgcaggagccacatggaataatttatttagtgctttaaatatatatatatgtcactaagccattttaaggaagataatcagaaaataattatcaagctgttttgaccaatataattcagattctacttcaaaaaattacaagagattgcctgaattattttttatattaaaaacatagcaggcatatgttacacaatgagttttgttctgtctttcatttgttaatactttcttaggatgataatagaaaaaaaatttgagaatttatctttctctgtaccatcaaatctacagttttccgttgtttattctcagtcatttccattcccaatttaaatgttggatataataaccagccatattaaaggcccgattctatgaatagaaaacatgaaaaaaaatttaagcgaggatttgggagatggtggtaggtaactgaacttggtaataacaataaaatgatcccaatcagaggctgttgtgtgagcacagcctgtacaattaatagtgacacttcagcagcaaagccactccaagaatcataccatcgtttgccattttatatttctctccaagattttccagagaaatgccatcaaaagcacaaatactatttctaggattccaaactctaagaaacatattaattcagaagatgttaaagcatcaaaacagagaggaaaatgttggaatggttactatttatgactagcttctgctctctgcactgaagagcgtagctatttccttcattttacagttgacattcagaaaaagtacattaaaagtacccagaaaagccttatctctgcatatttttgcaatttggaaggacaaatagaaacaacattagaacttgatacatttagtcgtactctgtattgtagacttggagtggaaaaactgtattgtagactcggagtggaaaaaacacaaactgttttccctccgctctcacaccacaacaatcaacacagatgacttctgtgaccaaatgtgtagcagcttctccacaccaacaagcaataggcaatcaatcagttctgcagcagacaccagctgggtgtcatccagtttaattccaacacagcctggatggagatatcatcagatcccacagcttaaaggctcagtcccacaagaccaccgttcgcttcacatggcagtcacaggccctgggttgttttacatgcgcttctgaccaattgtctataaatcagggttcccatgaccccttccttgtgttcaatgaatttgctagagtagctaagagaactcagaaaaagacgtgactcagtttgttgtaaaggatattacagagtacagatgaaaagatacgtaaggaaagacatggggcaaaggatgtggagcttccctcctgggcacaccaccctccaggaacctccacacatttggctctccagcagttgtctgaacctagtcttttttgtgtttacagaggcttcattacgaaagcatgactgacaaaaccattggctattggtgagcaacttaactttcagcctgtctcccatccctggaggttgggggtgggactgaaaatcccaaccttctaattctgccttggtcatcttttggtgaccagtctccatcctaaagctacctaggggttgccagtcctcagtcaaatcattagaatatgaaaatatatcattttggaaaccctaagaattttaggattgtgtgccaggaaatgatgtcaaagaccagatacatgttttataatatcacagacacatgcataggttgtccaattttttctaagtgaagttaaaaagtatttcaaccccaattgtcctattcttcccttacatcattccttcctatacttctgtctaatgtaattaagaagaacatcgaggggaaacaacttttacttgatcagagaattaactgaactattcacttcccaagtgttcaactgaaaggtagattattttatctcatcattttaggattccttttcttaactgatttgttgtttatattgagtaaagtacaccaatattaagtagtacatcttgaaaatgttttacatatttaaaggtaatagctattgtattttctattaccctatattaattttgtctgtttatgagccaaaaatagattgttgcagaaaatatgtactctttgtatcttatttctttctctgagtaaaatgctttttattttcatctattttctttcacacagcagtactttatcttcttttatattccactaaatgtatgaaatgtatgttgttttttcactgtcatgttgatggagatatgggatgattccagccaagggctgttacaaataaagttgatataagcattcttgtatatgtcttttggtgggcatgcatactgatagaagtggaattgctataggtagatgtatatttagctttaattgatactgccagactcttgcaaaatagttgaactggtttatattctcactgacaatgtatgagagttccaggtgctccacatttaatattgtcagtatttttaattttagccattctagtggatgtaagttggtatcatattgtggtttttaatttgcatattcttgatgactaatgatgtttgggacattttcataggcctcaactgtttgaatatctttttagtgaagatgttctttcgattttttgccctttgaaaaattggtttgttcatctttcttattgatttggaggagttctgtttttttttgagacggagtctcactctataacccaggctggagtgcagtggtgcaatcttggctcactgcaagctccgtctcccaggttcacaccattctcctgcctcagcctcccgagtagctgggactacaggtgcctgccaccaggcccggctaattttttgtatttttagtacagacgggttttcaccatgttagccaggatggtctcaatctcctgacatcatgatctgctcgccttggcctcccaaacagcagggattacaggcatgagccagcgtgcctggcatggaggaattctttttatattctgcttacaggtactttgtaatgtatgtgtacaggtactgtgtaatatgtttttccactctatggcttgcctattcactttattaataatgtcttttgatgtacaaaatttctttatttggatagagcccaatttataatttccttttttgtgtttagttctttgtgtttgtttgttgaaactttgcttacctgccaaatcacaaagatatttttctactcttctagatggttggtgttttagttctgtgtttagatctgtatccacctggtatttacttttaattatgatatgcaacagggaccaaggtttttatttccacacagttgctatagtaccagataaccagtgctatagtaccatttattgaaaagactatccttttctcccattgatttgcagtggtgactatatcataaaccatatacctgtgggtctccaggtctatttctgtagtttattatgctcgtttggtctattctgttatctttactcattatcaaactcctccagcttcttgtacatgtttaagattgtctttgttattgtacattatttccatttttaaataaatttggaatcagattgacaacctcctccccatgcctaccccccaaaataaatcttctggggttttgaatgctattgcattaaaaccgtggatgagtttaagtttgttggaaattgacatcttaacaatatatcaagttctgcagcctattaacatggaataacatctgcatttagttagttcatttctttcactaatgtgttctattttggaatagatgtattatgcatgtttcattagatttattcctaagtatttgtttttgatgctatgctaaatggtatttttatctcactataattgttattattatatgaaattcatggatatgaaatacaattaatttttgtatgttggcctagccagcaaccttactaatttcccttattagtcattgtttctttagtattgtttatgaccatgttatgtgtaaataatgatagttttattttttcttgccaatttttgtacattttatttcctttccttgctttattgcaatgcttcattccagtataatgtggaatgggtgataatagacatccttgtcttgtccccaccatcagaaatgcactcagtctatggtatcatgttattaattctctagtgaaaccatagtttgtatttagtaaaacaacaatgtacatttggctatttcaagcttaattgaatttctttggcctctacatgattcttccttgctgaaaaggataatttataacaaatatttcattacttataaagcaaacacttgcatttcagaatacctttgtatttcactttcaactctagaaaatatttgttaggaaagtataatttatgaactgttataatgctttagtttctattcatttatttgggatttaccatgtattgctttaaattttaagcaatttttatatgaattgcttctactctacactatgaacacaaattcaaagatagcctgtatttgtattaaatttctttgaatctcttaaggcaactagcataatgccttgtctcaataaatatatgtttattgctttagagaaaacaagtccattactattttcaaagttgaaattgcgttatatgtttaagctgccatttaaacagcactacattttgccataattttgctatagttaacattccaagtatattcaaagttgatttttatttttttcagaaaaaatgccttagtctgtttggtattgctacaaaagaacacctgagactgagtaatttgtaagaaaagaagtttgtttagctcacagttctgcaggctgagaagttcaacggcatgaccctggcttctggcaggggcttttattctgcatcataacatgacagagaaggtcaaagaggatgcagacatgtgtgaagaggggaaagtttgctaggcatcttagccctgtaacaacccactctggtggaaactacccatttcctcaagaactaatttagtttagtcttgcgagagtgagaacttactaccagaagaacaacaccaagccattcatgaaggatctgccctcataacccaaacacctcccaataggccctacctccacactggggatcaaatttcaatatgagttttgatgagaacaaaccaaccatattcaaagcattgcaaaaagttgaaaaagctctactaatgtgtaaccagacatgtgaacatatataactttgagacatagcacaacacttaaaagccttcagaatcataaaaaatgtatctatcaatcttaatattttattaactcaaattatttttacctggctgcatggacatacaacatttaccctaaatttaaaatagaatgcaaattaatattcattggtattattttcattaattgcacaacatagtgaaaataatgttaacatttttttcctttccttcttccttcttctcttttgctttttttcttacctgtaaattaactgagttgccagatatccatagttatcaatggcaatttggaggctctcagaggcagaagtggttggtgtttttctatttattgttctagatttgggtctgagcacttttataagtgaaactttccaggtattttgttgttgttgttgttgttatatcaggtcttaaactatacctttataaattcttagtcatatatactaaagggcatttaatctcacgactgttatttatgggctttaagtcctctatgcaaagggtaaaattgtccctgtgaatttcagaggtagacattaggtaaagagagagttttttgcttgacttattgcttaagtcagagcgttctctgaatcttctaactcttcatttaattcacttgaaagtatttattaatcaatgtgcctaatacatagatgggactgcttccagtgagtctgtcagtcatgttaccagagcctttatttcttcctctatgccaagcttaaaaaatcagatgatttattttacatgagccacacatgcaaatagacctgtaatgctgaaattttgatacttaaaggtaaatctagtatcagagagctctattaagtggtctagagtatattcaaattacaagacatgcaacttattctaaaatctaatgcaatctactaacagcaagggagagggaactattcagagtaaataggacattgtttatctgaaattttattgacacattaattgacaactccattttatatgacgtatacaatcaactggacctgtttaatgttagtccttagataaaaaataattgtagctcaagacctcataattgtatatatttttttcactgtacctggtacaatcatttcatgtatgaaatgaatgagtccacaatacctcaatatttgaacattttgttttaattcacttaatcattgaaccacagagtctgtgctaaatgctattatctctataactcaacaataaggagatttaacagactcaccatttaatgtgcacgggagcacagatttcaaaatttgtttcagcacaaccttttggattatcatatatttgtaccataaaataaatcatctgattttttactctactgagacggatgcatatgcaacatatttatgtgcatatattcagtgttggaaattaattcataatcatgtatatcaagtgatttggatatttacctgcaccccatctcagggaatcattagagcttgcatttggaacatttaactgattttagttatgtaatgtaattttacacacattaccttacatttcccttcaaattccttctgaatcacactgttctgatttcctggaaacgcagttcaagaaatggccaagagtagaaggatgttataagacattgagtttcgaagttttcctttaaaatacaaaaagtgaaaattccacaaaagtggaatgaaacttgatttatagtgccgcaaagaaaaatcctggaatgtgcaggaaaggaagtgaatgaacttgggaacagctgcaagtaagtatgatgaacgactctgcattgggctagcagttcatctgttccacttgcagctgcaggccaaagcgtcaccaggttttctgcagaaactcaacttggcattttaatggctgaggtgaacccactggtggccagctgctgggactgaaaatcagaagcagctccagtccttccagattgtgaggggaaaggttaaggagagggaagtggtgccttgtcccagacagacgcccattggtcctgagatttcaaaaacaccaggagagagaatgcctggcagtggagaaaccaacactcagccttctctggaagaaagaaaaggcttgaggcaggattctcaagcttcatttaattacgatcaaatagggactggcagaagagcgtagctgcagatttgcagtaactctccctaaaagaacatgagctgtgagagagtgaccttgcagccagcactgatttgacattcacctgtttccctgcttgcattggaataccgctgggttagtttggatcccaaacatagaaaagtaactcctagcaggaggcagaagagagcacttaacattatgcggccaagaggttacactggctgctgcctcttatcaatgggtctttcaggtcctttttgggagcaatcctgggcttcattgccctgcctaaactgtagtttccaagcagtttctcaggcagttcctgttacattctgtgatcctgcctaatacagtaatttgattccagttgaaaacttccattacatacatgtcttgaatcgggagagttagagccttatactttgttcctctgcaaaactgtaagagcatcactgctgtattaaagggaagtgagtggaaagttgcaaagtgagcctttgagttcaagaaaacagatgaaaatgagcccaagccttggaactacagttctaagttttgagtggtggacagagtgggaaaccacgtagcatgcaaaggggagcggaagggcagaggaaggaagcaaggctacagtgtttggctgtgttctaatgtgctctggcatggagttatcgtgagtggaactaatattacataacactatgtatattttggaagatggctgggaaatagcctttggagccaatggagatttattaaataaaaattacctcaagcttgatttttcatctttaccaagcaccatagtaaattggcatctctgagactcctgcgggagccagaaagctggaatcaaaaattcagaaacatgaaatcaagaaagaactgaaaatctgaatggaaagccagtcacaaaagaataagaagtaaaatattctttaattatgtattatctcctacagatcaaaaggaactttccaccatttcattgaacctgtgagtgaaaatgatcccaaaagtatagagaaaataaagaacagtaagcaaattaattcagtttatatactgtcttttaacctgtttagaaagaatttgagaattgtttgatcctgattatataaaaaagatatatctgtatctatgtctacgtatatattaatacatacaaataaaatttctagaaggaagagtacacaattaacagtggttacttctgaagaatgggaatgggatgttggaggagacagatctgtcacttttcattttatatttctctggtgagatcaagggagcatcttactttgtaaatattaaaaatgctgaaatatgtaggttaaaatgtaattaatctacattcctatttttcagaattaatctgacttaccatctggtcatttttgcttgcttacattttttcttttgcaaaactcattatgttgttttgctaaaaacaattaaaacaatgcatcaaactagtaagaaaaaaaaagtctcaaaccacagagaaagactcacaattaccattagatacataaaattctatgatatatttctttgtacatttctggatcaaataatggcaagatggatgaactgatggatagatggatatatagacatgcatcgatgtaggcagacagtaagatcatagtataattgatattttaatttaacagaaggttaaaactgaaattttgcttttagaggaactattgacctcaaataaatgttttattttcaccttaagacgtatctttttctaaaagatccaaagttaacttgaaaaacatggaagtcgatttttttttttttttttattttaacctatcaagctcaattgactccctctcataaaagtggaggcacagtggctcacgcctgtaatccccgcactctgggaggccgaggcgggcggatcacgaggtcaggagatcgagaccatcctggctaacaaggtgaaatcccgtctctagtaaaaaatacaaaaaattagccgggcctggtggcgggcgcctgtagtcccagctactcggggctgaggcaggagaatggcgtgaacccgggaggcggagcttgcagtgagccgagatcccgccgctgcattacggcctggccgagagagcgagactccgtctaaaaaaaaaaaaaaaaaaagtgaagatattgccacaggtctcaggtcctctttccctgcttcactttctattagttttatcagttaggtttacatttactaagtttagagcatatacaatctttttttctttttttttttttgagacggagtctcgctctgtcgcccaggctggagtgcagcggcaggatctcgactcactgcaagctccgcctaccagattcacgccattctcctgcctcagaccccggagtagccgggactacaggcgcctgtgcaatctctatggtaaccacatttcccagttgactactaccggtaataaaatcaaatggattcagtgctcacaactcttcagtctttgggctactttccattcttgaatttttagctgaattcatctctttggctggattttgtggtaaagtagttttttgcttattttttcccccaagaagggcttacatgggtctttttctatgaattattttcctacttgacaatatttacttgttacttttttactttcatcatgccttgggcgcatataatactctcccttcacattttctttccttgaatttgtggagaattttccattttattcttgcagtcaactttactgaaaacaaatctgaaataaaattaatgttattctaccgtataggcgattggctttttagtcccaagatgcctaaaaataagttacccttaacacataatagcttaacttagttaggtctagaaattgagggtttgttttgtaccacattttctagaaagagtgctccttcaacctaaagatttacttagctttttttcaggaaatttcttggattagatcttagaataaatatttattttcatttgttaaattctctacttcaggaatatctgttaacattgtgttggatttttttgtttaaagtattcacttttctctaattgcttttatctccttatctgttcatcttccttcactataattatcttaatccccatttctctgtatcagtaacttaattttcaattgcatccattgtttttctaatttatgtattagtttcataaggctattgttttgagttctttcccccttatatcggtactctcctttatcatctaattctgttattctattattttgtctttgaattttgttttagtgaacttacattcctctattatattacattatattagaattagtagttttgagtaggttggttcatgagtttgtgagtagggtagtttcaagtagggttgagtagtatttttatgtttcttgtgataattttgccaaacaatgaatatttctttttagtataaagatgtctcatggaatatttaggacatgtatatgctaaaatttatttgttgcttatatgaatttcaaattgagctgggtgtctctatttttatattttaatttgctaaatctgtatgttttttataaatttccttccttccctccttccttccttccttccttccttccttccttccttccttccttccttccttccctccctccctccctccctaatctaggaggattttatagttgccatagcgttttcttttctttttgctcatgcttgtgtgtccctaagatgccaagttaggtgggatatattgtaggtggcctcttgactctcttctcaccatactgtttgttttctttacttaatatacagtctgagaactgaatttactttcatggattatctgtttgtctgtaatctatgggaatactgggtgatgaaggcagggatctagtcttagatactctgcagccttttctctgtctcctaagatattttttctgtgcaatgggagaggggtttttgtccaatcccctgggaaatactataaatgaataatttctcaaatttgctgtgtattcttgaatcttcactctcttcaaagagacttaagccactatttcattccgggtaggagcagctaaactaaactaacagaaaagctacaaattacagtggcttaaaaaacaaaggacatttttcttgcttgggtaaagtttcatttatttttccctctatttcattgccatgacttttagggagcagtgacttctaaattgtggttcttaatcaactagagtttatagtttgtctaacattttaaaaatataatcagtttctttactactatttttatattactaattcattaattttcacccaaatctttaagaacatggctctcatggttagggaaagaaaattgcgcaaaggacttgtgtccataccgtttttttggcctcactattcctgaatgtggtttctttcttctaatgaccaaactttaggggactaggactgtgcatctcagaattaaactggtatttctgatatgtatggtttatggttcaatggaaaaatataagaatttttcaaataattttctgattgtaaggatgaatgtgacctaatgttaaaatggcaggacagaaatattaaagaactgaatgatggcatcagctcagccatttagtatttgattttggacttagtttcctcatctgtataataagagctttgcctatgtatttttccaagaccatttcagggttttgcattattttatttcatttggaattaacattcaggtcatcttatagtagtgtactgaataactgaatgttaaatgtcttgctaaaataaatattgggttggtgaagttgaagttttggaataatagctaaaattaataactatagattttaattaatgatttcattcactaactttcaaaagttagacattcaaaaactgcaagaagaatattttttcaagattataaattgctagattcttcctgcagtggaaaggggaacatgagatatttgcagtattaaatagatactcactttcaattgatacatttaataacatcactaaccttcctattcatagtgaaatgagtgatgaaaaagttttttagtaaatattttttactggaacagaaataattttgtagcaggattcataatttgtgtatactgatttaagaatatcattacttcctgaaagtggcattcatctctatgggtagtcattttaacaaggtttttgttaaaaccttccccttcattaacacactttaggaaagtgtcttctaagtcattctatcaaagtctgttgctttcaaatttgattaaagaaaacaaagtattatttgcgtacctcatttttctctaacacatttttctttgcatttctcatattctggattatgtggggatcaaatatgatttaaatgttatgcacaattttgtggtttttcctactaatgaaattttgagttgcaaagttaacattctgccattgttaatatattcttattataaaaagacaaaatttcaacacatttcatttaaagatctcaattggcttttacttgcaattccagaatcgggcagccattagaaccaaaacagttctgaggagctcccaggctgcaatgtggtgcgaaatgttttatggacagaaaatggaaatgaggtgcagaaattggaggtgagattcagagatagctgattggttacagctcagcctttgccttgtttgaacatggtttgaacagttgattgactgaagctaggctgctgtgattggctgatactttactatttgttacaaaggcaaattcctaatttaagctttcaaattgtttaagtactaagttaggttttactttgttacttaggactcatatcgaggtttctaaagcccacatctgatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaaagccacaaattttaaaattctgatataatctaatatctggtattcagctttgtattatcattttaaaatttaatgaacatctctggactctaaatatttttctttttaaagttatataaaacattctctttatattcattataactattaaactatttgcctacttatttatattgaaagtccttaatatttttacaataatttaataggtttcacaatcatcattacttattatagtttatactgtttgaataataaatatatgtctatactatgactcattgatacatttcaaaatacagtgcacataagaagatcttcattctctagatctgtcatactacatatgtgaaagttaacatttgtagtggcagtgaatcctaggggcagccttgcatgttaatgttatgtggttgatttgagaggatggggatctgtgtaatcatatgatgacaatttgggtttgggaatctcagaaatgccatcagtataggaatatggctattctgctcttcctaggctaagaataaacttgaagacaaagagtagattttggccagacactgatgctaaagtcaccccgatgctgtctttgcttctaaggtataaattaccttattttaagcaactttttcaccttttcaactctatccctttcctcagcctctttcatatgtgaaataaaatattcacttactactgaggatgattttttttaaacctattaaagaatactccatagctacagaggggaccatatcctttagagactccgttggggatgatcatatgcagaattattcttgtccctttgcctctgcttaatccccttcacaaagtctgtggctcaaacaaatgagagttggcagtactaaaggaataagttcccagcatacgtctgccatgctttagcatcatttcagattagaagcatggagcaaaggcagggagacgggtcaaacaaaatgctgagagcttccctccttttaaaaaacaaaattctagtcagggaattatttttaaataaaatgcaagcccccaagacataaataaacagccagcatataatactaacaactcaatgaaagatacttccccaggtcaactcatctggtaggatcagttattttgtgttactgcattgcccctctagcgggatcatagaagaccctaaaggctacaagaagaactgctttctggctctcaagtcatttcagtggttccctgatggcagctgtctctttggggaggtggtgccgtggtctgtttggggttaggccatcagcacaggccccttgtgctagcatcacattgtcataagctttctgctaccatggctaccatccatcaccaggctctgtctccatgggcagcagcctctgtgcccaggccaccccaggacctcaggcccatctctctttccaaaggtaggtaggtggccttttcccattctttagtttttgactttgtataactgaagcttctcctgggatgatgcaggcagctgctgcacagtcactccagacttactcttcactttgttgttaggcccctgcagctcgctgcacgtgactggtgccatctgccctccccgcacgggcagctgcccctcccacactgcctatttccccctttctgctttttgtagccacatgtctaaagatggcaggccagtctctgtggtctattttatgggactttcatttataactaggcagcaacccacattagttatttatcctgatgatctccctcctcttgccccccatgacaggccccagtgtgtgttgttcccctccctgtgtccatgtgttcttattgttcagctcctacttataagtgagaacgtgtggtatttggttttctgttcctgcattagtttgctgaggataatggcttccagctccatccatgtccctgcaaaggacatgatctcattccttttaatggctgcatagtattccatggtgtatatgtagcacattttctttatccagcctatcattgatgggcatttgggtggattccatgtctttgctatcgtgactagtgctgcagtgaacatacacgtgcatgtatctttgtaataaaatgatttatatcttggggggtagatacccagtaatgggattgctgggtcaaatgatatttctggttttagatatcacaacaccatcttccacaatgattgaactggtttacattcccaccaacattgtaaaagcattcctatttctccccaacttgccagcacctgtcatttcttgactttttaataatctccattctaattggcatgagatagtatctcattgtggttttgatttgcatttctctagtgatcagtgaggttgaacttttttcatatgtttgttagctgcatgaatgtcttcttttttttttcttttattttcttttttttgagacaaagtctcacagtgtcgttcaggctggagtggtgcagtggcaccatcttagctcaccgcaatctccaccttccagcttcaagcaattctcctgcctcagcctccgaagtagctgggattataggcacctgccactatgcccagatacttttttcgtatttttagtagagatggggtttcaccatattagctaggctgatctcaagctcctgacctcaggtgatccacctgcctcagcctcccaaagtgctggggttacaggcatgagctgcctcactcagccatgaatatcttcttttgagaagtgtctgttcatgtcctttgcccacaattgtattgttagtttttttcttgtgaatgtgtttaagttccttgtagattctgggtgttagacctttgtcagatggatagattgaaaaaattttctcccactgtgtaggttacctgttcactctaatgaaaatttcttttgctgtgcagaagctctttagtttaattagatctcatttttaaatttctgcttttgttgcaactgctgttggcaattttgtcatgaaatctttgtgcccatgtcctaaatggtattgcctagattttctagggtttttatagttttggggtttacatgtaagtctttattccatcttgagttaatttttgtgtaaggtgtaaggaaggggtacagtttcaattttctgcatatggctagccagttcttccagcaccatttattaagtagggtatcctttccccattgcttgtttttgtcaggtttgtcaaagatcagatggttgtggatgtgcagtctattttttttttttttttttttggagacagagtctcgctcttctgcccaggctggagtgcagtggcaggatcttggctcactgcaagctccacctcccgggtttacaccattctcctgcctcagcctcccgagtagatgggactacaggcacccaccaccatgcctggagatgtgcagtcttatttctgagttctctattctgttccattggtctatgtgtctgtttttgtactagtaccatgctgttttggttacagtagctttgtaatatagtttgaagttgtatagcatgatgcctccaggtttgctctttttgcttaggatagtcttggctgtatgagctcttttgtagttttatataaattttaaagtagtttcttctaattctatgaagaatgtcaattgtattttaatggaaatagtattgaatctataaattactttgggtgttatggctattttcacagtattgattcttcctatccatgattatggaatgtttttccatttgtttgtgtcctctcttttttccttgaacattggtttgtagttgtccttgaagaggtccttcacttcccttgttagctgtattcctagatattttattatctttatagcaattgtgaataggagttcatattcattatttggctctctgcttgttattgttggtgtatagaatgcttgtgacttttgcacattgattttgtgtcctgagactttgctgaagttgcctatcagcttaagaagcttttgagctgagacaatggagttttccagatatagggtcatgtcatctacagacaaagacaatttgacttcctttcttcctatttgaatatcacttatttctttctctttgcctgattgctctggccataactttgaatactatgttgaataggagtgttgagagatggcttccttgtcttgtgttggttttcaaggggaatgattccagcttttgcctattcagtatgatattggctgtaggtttgttataaatggctcttattattttgaggtatgttccttcaaaacctagtttattgagagtttttaacatgaagggatgttgaattttattgaaggccttttctgcttctattgaaataatcatgtggtttttgtcattggttctgtttatgtgatgaattatgtttattgatttgcatatgttgaacaagccttgcataccaacaattaagccaactttatcatggtggataagctttttgatgtactgctggattcagtttgccagtattttattgaaaatttttgcatcaatgttcatcagggttattggcctgaagttttctttttttgctgttatctcttccgggtttggtatcaggatgatgctgccctcatgaaatgagttagggaggagtccctctttcaattgtttggaatagtttcagaagaaagtgtatcagtttctctttgtacctctgatagaattcagctgtagaccagtctattcctgggcattatttggttggtaggctatttattactgcctcaatttcagagcttgttattggtctactcaagaattcaacttcttactggttcagtcttgggagggtgtatgtatccaggaatttatgcatttcttctagattttctagtttatttgcatagaggtgttaatagtatcctctgatggttgtttgtatttctgtggggtcagtggtgatatccctttatcatttttcattgtgtctatttgattttctctcttttcttctttattagtctagctagtggtctatttttaattttttttttcaaaaaaacagctcctggattcattgactatttttaaaggttttttgtgtctttattgccttcagttctgctctgagcttggttatttcttgtcttctgctagctttgtggtttgtttactcttggttctctagatcctttagttgtggtgttaggatgtcaatttgagatttttctagcttttcaatgtgggcatttagtggtatacatttccctcttaacactgctttagctgtgtcccagatattctgatatgttgtctgtttgttctcactcatttcaaagaacttcttgatttctgccttaatttcattatctacccaggtgtcattcaggagcaggttgttcaatttcgatgtagttgtgtggttttgagtgagtttcttgagttctgatttgattgtgctgtggtctaagagactgtttgttgttatttcagttcttttgcatttgctgaggagtgatttactttcaattatttgatcatttttagagtaagtgacatgtggcaccgagaagaatgtatattctgttgttttggggtggagagttctatcgatatctatcaagtccacttgatccagagctgagttcaagttctgattatctttgttaattttctgtcttgatgatctgcctaatattgacagtggggtgttaaagtatccccacaattattgtgtgggagtctaagtctctttgtatgtctcaacttgctatatgaatcagggtgctcctgtattgggtgcataaatatttaggatagttaacttttcttgttgtccccttcaccattatgtaatgcctgcccttatttgtcttttttgatctttgttggtttaaagtctgttttgtcagaaactaggatttcaacccctgcttttttctgttttccacttgcttggtaaattttcctccatccctttattttgggtctctgtgcagctttacatgtgagatgggtctctttaatacagcacactgatgaatcttgactctttatccagctttccattcttttagttggggcatttagcccatttacatttaagggtaatattgttatgtgtgaatttgatcctgtcattatgatgctagctggttatttgcagacttttttgatgaagttgcttcatagtgtcattagtctgtgtactccactgtgtttttatagtggctggtaacaggttttcacttccatatttagtgcttccttcaggaactcttgcaaggcaggcctggtggtgacaaactccctcagcatttgcttatctgaaaaggattttatttctcctttacttatgaagcttagtttgaccagatatgacattgtaggttggaaattcttttcttcaagaatgttgactattgccccaatctcttctggctttttgggtttctgctgagaggtctgctgttagtctgatgggcttttcttcataagtgacctggcctttttctctggctacctttgacgtatttttcttcattttgacattgaagaatctaatgactatgtgtcttggggttgttcttctcatggagtatcttactggggttctctggatttcctgagtttaaatgttgccctttcttgctaggttggggaagttctcctgggtgataccctaaagtatattttccaacttgattctgttcttcctgtttctttcaggtaccccagtcagcggtaggttcagtcttttaacataatcccatagttcacagaggttttgttcattccttttcattcttttttctctaatcttggctgcctgctttatttcggcaagatagtcttcaagctctgatatcctttttttccacttggtctattcagttattgatactcgtggttgcattgtgaagttctcatgttatgttttttcagctccatcaggtcatttctgtcctctctgagctggtgattttggttaacagctcctgtaatattttatcatggttcttagcttctttgcaatggattaggacatacttctttagctcagtgaagtttgttattacccatcttctgaagcctacttctgtcaattcatccatctcagcctcagctcagttcagggcccttactggagatatgttatgatcatttgaaggagaagaggcactctggctttttgagttttcaatgtttttgcattgattctttctcatctgcatgggtttatttacctttgatctttgaggctgctgacctttggatgaggtttttatgggttctttttaattgatattgttgtcctggctttctgtttgtttttcttttagcagtcaggaccttcttacatagggctgcagccatttgctgggggtccacttcagaccctattcacctggggtcctcccacacctggaggaatcaccagtggaggctgcacaacagcaaagatggcagagtgctccttttccccaagaggagcaccaacctgatgctggccagagtgctcctgtatgaggtgtatggagacccctgttgggaagtctcaccgactcaggaggaacaggatcagggacccgcttaaataaacagcctggcttcctcttggcggagagggtgtcctgcactcaggagaatccgcctcatcagggctgccctgactctccagagctggcaggcagaaaagagtaagattgttgattcacgataccgcagccgcccctcctcctatgggctcctttcagggagatcagagttctgttcataaacccctggctagggatgctgaaaatcccacagggaggccccacgcaggtaggaggaatgggtcaaggttctgcttaaagaagcagtctggccaggaactgtccacagctgctgtgctgcgctgtggggaattgctcccgttccaaactgcccagtctcgctggcacctgcagcagggaaaaacggctgactggagcagcagtggtggtagccaccccttcccccaccgaactcggtcttcttaggctgtctccaacctgctacactggctgacagggattccaaagtgggtttcagtttgtagggttccaagggagcagggccgctgagcaaggccgcttggctccctagcttcagcccccttcccacaggagtggacggatctcctgcctccttagttttcccagagctagagtatgcaaaaactcttatgtctcagtgtctgcccaagtggtcgcccacctgagcagccgctgtgagcctgcacagctctgtgttttggacccaaggcccttggtggtgtgggctcacaagggcgtgggttgcagagatccatgggaaaagcgtgcttttcagagctgggtagcacaatacctcaccagcttcctcggctcagagagggagcaccttttgccgcacgcaggctccgggtgggccctcgctccaccctgcttttcctcactgtctgtgggttgcgccaaccatctagtcagtcccaattagagaacctgggtacctcaattgaagatgcagaatttacttgctctttttgttcttggtggaagctgcagactggagctgtttctatttggccatcttggctcaaggttcagtttgagtttctgttgcagacactgcaagaaacagaaccgaatgaacaagagatatgaaagtatgtatcatggcaataactgtttctgtttatttcttattttgttttattttgctttctaatagaattggaggaaataggaagtatttaaaaagtgtttaaatttaccatcaattattcctgtatagttctctatttttaaaaatatgcccccaagttttgaaattctgattcaatacggactttgaaaggatgtgaaatttgggagcacgtattgctgttactaagactgggggctgtgagagggcttggtgttcccccaagcagtcaggcttgcagagagaatttgtgtcctgctacggtcttttgtaaaggaagctagccccacctgttgttcaaattcattttgcttgcgtgaaagaggaatgctgtccctggaaacctctgtccaagtgcctgttttttctgttgtgggcagcattgcaaaagtgatctgtatcctctcagaaaaaggaaaaaaaaatcacatctaaaaatgttcaatgtcattacattgaacactgaccggacaagtaagctggaactgtatggttatattcacaaattctgggatgtttgttttggctttgtgttataattgcagctacgaaactaaaagtgaacaaattgctttctcatttaatttctttttatcatgtctaagtctcagtatttttatttgtagaattgtgttaataataatccacaggcttactatgaggaataaatcagatactgtacataaaacaaataggatatttgttgacatatagtattcattcaccagatgcttaatctttccttcctcttgtctatgttagcctgcgattgttattctagtgttggtctcaaataacttaaactgtcattagaattttgctttaattcatagggccaatagaggaggaggcaatggaaaaatcactaggtatgtttgcttagtctctcagatgctatagcacacaactctcagagacttggaaaaatggaaacacagagatgttgttttgtgttttgtttttgagcacagttcttatagtaaatgtgaatgtttactattatttctagggtttatgataaaagatggaaaagagaggctatactgatgaacgttgtcaacatgggggcttgtcagaaattaaacaaacttttaagaaagtaattgaatttaacaaacattattgagtaccttatctggcccaggcatggatcttaacctcaactcctcatcaagggtagaaagtagactcagtcaatgctaggcatggtggttcatgcctgttattccagtgcttttggaagccaaggcaggacgatcgcttgagaccaggagttcgagaccagcctgggccataaaccaagaccttatcgctacaaaatagaaaaaaaaaaaattagccggaaatggtggtgtgtgaatgtagtccaagctacttggggctgaggtgggaggattgcttgaaccgaagagtttgagcctgcagtgagccattatcacaccactgcactccagcctaggtgacagagccagatcctgtctcaaaaccagaaaacaacaaaacaaacagacaaaaaacagactctttctagtcatgactttattccagtgcttaccacctggtccttgccctcagagttcacaataaagggattctggtctgggaagaaagcaactttaaagaatttctatcatcattctcataataccaataaactccaaaaaagagcctaaagattttcaaatgaccttccttagaagttctagatcctagttgattacctgagcaaccatttgcctatgtgtatttcaatttaaattgtcataaacagctactcaaggaattgattaatctgaattcaaaaataacttttatttagtgaaagtcaaagcacattattgtgttttaaaaagtcaaatgttgccaactcatgacttagttaagcctggaatatgaatgtgcaattgaagcagacattggctgtatgcacaatgcctgctgtttttcttgctgttagtcattatatgttatgtcctttgtcaggttggaaacaaaagattaatttcatttggtaggcttttaaaaatgtgtttgtctggttgtgtgtgtgtgtgtatatgtatatatgcatatatacacatatatacacgtatgtatgtatatatatgtatgtatatatgtatatatgtatatacacacacacatatataaatttagttctgaaatttaggcatatatatatatatatatatatatatgaaatttaggcgcatatatatatatatatatgcgcctaaatttcagcactaaatattaaagtttaggcttaaagtaccaagatatttttttcagagatggattattttagcactaaaattcttctgagccttcagtattgctgagctttatttaggaaatactcagtgatagaagatgaatgcaaaaaaaattgattaaaaaccggagccttaaaaattgaattcccttcttactgttgatgttcttatattattttggtatctacataaatgattatttgaaaaaatttctgacatctgatgatgtgtaacatgccaaattaatttccgaatgttaaaaatcattttacttatggataacttcattatgtagaagctgactatctaatttgtaattatttttatagaaaaatggcaagtagaagcttatcatgggtgaagttaacaacaaaaggctaaaatttatttgtctctcttcagtctttttctcttcagtcaaagacaacttacacacaacaagatttctccttcttaattactacatttattatggtatttaccctgttcaaaaagccttagtgaggttccagctttgaataagatagagtaaacatactgtgccctgtctgtcctactgaatacaactatcaaacctggacaaaacacatgaattatattttcaaggactctgaaaagtgaattgtagcagacggactgagaaagaccagacctgaaaataaaacaaaaccaggcgtgagtttaccatgtttatcctctggaggaacccagctttgacttgggaagctcagaagtagacatcaacacaggcaggaagagcttcacctggcagtgacggtgacagcagctgagggtccccaggtttctaaagctctcaggacgagaaagtaggtcccaagataaggagcctaaagggcttttttctttctgtgtattccttcttggcctccaacatgggtacagtcacaagagcatgtaacagagaagaaggaatagacctaccattttctagataaagaattggaaagaggatccacaggtaaccaaaaagtaccagggaaatggcagagaaggaaaacctcaggagaccaacctcataagtggtatttattagtgcctgggctcaaatccaaattgtacatgaatatgtctggtcctagatagggtaccgaagactttgaaagtgaattttggtatatcattgcccagattccagactggctattgtgtgacacaacatacaggatatatctgaatagtgctcagaagagtttgaaaatgcaaatgatattaaaataaagatgaaaaagagaaagctggtcagaacttgtggacataacccttctggatctgttgcctgattaaaaaatagttgatattctcgaatgaattaaaacaagatttagagactgagcatggtagctcattcttgtaatccaagcactttgggagggcaaggcaagagaattgcttgcggccaggagtttgagaccagcttggccaacagtgagaccaggttgctaggaaaaagaaaaaataaaaaaataaaaagctgggcatagtggcatgtgcctgtagtcacagctacttgggaggcttaggcaggaggattacttgagctgaggatgtcgaggctgcagtgagcacatcactgcactccagcttgggtgatagagcaagacctaaaaattaaaaaaaacaaaaaacaagacttagagtctcataatattcagtaagtctagcatataatgaaaaattgctcagcatatgaagaactaggaaaatttcaacttgcatgggaaatccaacctacattaacactgagatgacagatcttggaattacctgactgactctaaagcagctgttattaaaatgttccaatgagtaagggcaaatctctttatatgaattgaaaggaagaaggtctcaacaaagaaataaaagaaatacagacattttatggtaactttagaactaaaaaacacaataactcaattaaaaaaaaactcattggaaggctccatgaaagtgacagaggaagaattggtgaatttgaagatagattgatagaaattatttcatatgaacaacacagagaaacatgatttcaaaaaaaatgaacatagcttcaggaagctgaaggacaacataaaaaggtctgatatgtatggctttgaaaatccagaaaggtagaaagagtgcagtgtgtgtgtgtgtgtgtgtgtgtgtgtatgaacatgtacacaaacgtatataaacacccttatgtttgaagaaataatggctgaaacatcccaaattagccaaatcacataaacctacagattcaaggacctcagaaaactcaaaataaacacaaataaatccatgcccaaagacatcataatgaaactgctgaaaactaaagacaaagagaaaccttgaaaaaagcctgaaaaaaaatgatatgttccttgtggagaaaaatctatttaaataacttcaaatttcttgtcaaatttcacagaagctaaaaagaaatcaaccaacattttttaaatgctggaggaaaagaactgtcaagtaaaaatattatatccaacaaaaacctcctcaggaattaaggcaaaataaagacattctcagattaaaaacaaaataagacaaaacaaaacaaaacaaaaacccaaagataccctctaaaaagtttgctgaagaaattcttcacacacaagaaaataaactgaagagcaagtttcatgaaagaacagcagaaatggtaactatataaataaatatagtacatatcatccttttcttgagttatttaaaacacttgagagtcaaaagcaaaaatatgacattggctgatacagtttttatccagtatgcatatttaatttaaatatctactataatataaaaggacctatatgatggtagtaggattcctgcattctacttgaaaaagtaaagtattgattctaaatataacatgaaaattaagcatgtatatagcaatccctggagcaaccaccaaaatttttttttgtatacacaaagagatacagtaaaaaacctgatatacttcggtggaatgctaaaaataatccaataacacaaaataagacagaaaagctaaaacagaggaataaaaatcagaaacaaccagcagaaaacaaataatgaaatggtagacttaaatccaagcatatctatacttgcattaaatgtaaatggtctaaagggccaatttaaaggctaatgattaccagaataaataaagaaaaatgtatgatgcagcaatatgctatgtacaaaaaatcactttaaaataatgacaaaggtatgcccaaagtaaaaaggtgggaactataaaccatgcaaacattaaataaaacaatactcaggttgctatatcaatattagacaaaatagacttcaaagcaaggaaaatgactgggaataaagatgacattaaataataataaaaagaacaatttactaagaagacataacaaccttaactatgtctgtagcaaacagcatagcatcaaaatacgtgaagtagaaactaacaaaaatgaaaggacaaacagaaatattcacaattatactttgaagattcaacagtactttctagaaaattgacagaactagtaaacagaaaatatgccttgatatagaaaagctgaaggaaaaaaccaactgactgaatatagttgatgtttttctcactctactccaaaacaatagaataggcattcttttcaagtgcacgtggaataatattacatttatgaagatagacctcattctaaataataaaacaaatttatggcaagttcatggaattgaagtcacacaaaatatgttttttgtccatagtgtaattaaattagaaataaatgacagatgccaggggaaaaaaattccgaacagtttgaaattcaacaatacacttctaaatactctacagtcaaagaagaagtgtcaaaaaaaaataaattatttcaaactgcatagaaatgaaagtacagcatatcaaatttgtggaatgtctgcaaagcaatgtttggaataaaatttattatgtaaaatgctcatgttatgagaaaataagttctcaaatcaataatataagcagccaccttaagaacttacataaagaaaagcaaaaaaaaaaaaaaaaaacacacacacacaaagcaatcagaagtaaaaataataaagagcatacatcaataaaactgaaatcagaaaaacagtagaacaaattaatgaaaccaacaggtggttcttgaaagagattaatcaaattgatgaacctcttgcaagactgacaggaacaaagataaaacacacaatatcagaaatggaagaatcaccactactgacaccatagcattaaaagcataagaaggttatgtgtttatttatgtataatagcaataaataattagcaagcacaacttaattagtaatttcacttaaaatagctttcagaatgtgaagcacttagacataaacctaacaaaacatgtacaagatatgtatgctaaaaactacaaaccctcatgaaaaaatcatagatgacctaaatgaatggagacatgtaccttgttcatggattaaaacactaaacttgttaagcatgttaattctactgagttgatctatagatttaatgcaactccagtcaaaatcacagtagaatattttgtagatatagacaagctagtgctaaaattcatatgaaaaggcaaaggaactagaacagccaaagcacttcttgaaagaaatggagaaattatgtgctcaattttaagaattattaaaaagcttcagtaatcaagagtctggtatcagagacgagatcagtgggtcccatagatcaatgggacataaatagacctgcataaatatgccaactcatctttaataaagatgcaaaagcaacttactgcagaaagggtaatgttctaacaaatagtaatggaacaataggaaacaattggtatacagaagaaaatgcaacctaatcctcacatattatgcaaaaagaagctcaaaatggatcgtagatttaaatgtaaaacacaaaattataaaatgtttagaagaaaatcttcatgacctagagttagggagtgagtttgggcatatctaagaagaaaatatatgtatatatttgataatttaaattggactttatacaaatttaaaacttttgctctgtaaaagacactataagagagtgaaaagataagctatagacagaaataaaatcttttcaaatttcatattcttcaaggggtttgcattcaagatatatttgaaaactcttaaaaatcaatggcaaaaatacaaagaacacgatttaaaagtgggcaaaagtcttgaacagattgtcgaccaaagtagatatggggaaggtaatcaaacagaactatgtgcaacatcattagcttaacttagggaaatgcaactaaaatgataatgccatagcactagaatgataattataaaaagaaaacaaaacgaaagaccctttcactaccaactgctggtaaggatgtggagcaactagacttcttatacgttgattatagggatacaaaatggcaaagctgcttgaaaaatgggttggcaatttctcagaaaggtgaacaaatgcttatcatatgacccatacatgccattccttagtatttatgctagcaaactttaaatttatgttcacaaaaaaccatatgtgaatatttatagtagctttgttcatatttgtcaaaaattgacaatcatcaaaatgccattcaacaggtgaatagaaaaacaaactgtggtatctgactacttcttgtcaattaaaaggaatgaattattgatttgtgcaacaacttggatgaatttcaaaggcattatacagaatgaaagaagtcaacctcaaaaagtttacctaccatatcatatagaatttcaacaaggcagagttatggtggaacgaaatcagtgagtgccaggggttggggtgggggaaaagtgtgactacaaggagatagcatgggaggttttgggggaactgatggagctgttccacatcttgattctcatggtgattatataaatctatgcatgtgatataattcataaaactatgatttatatgactataaattaattttaaaaataaaactagaagaaaaaagtcttcccaatgcttgactattgcttttagattatcctctaaactccatagcaggcaatgaatggcttccattctctggctacactcattttcccaacgtatttttttgcccagcattgttgtgaatctgttctcagtgtctcactcactttagtttttctctattccctaaagatccgagttataatatacaacctcaccaatgctgattatttgagaccagcagcatatctggagctggttaactgacagatgtgattggttggaactttacctaattcacccaaggcacatttggttttcaaagacttgaaaagggatcaatgttctcatctgtgaggttttaagacttttgtaggcgaggatgaatttcattctactgacaacctgaacgttttttcatgatttcaatacccctataaaaagataaaggcagctgggaatacttactctagaagaaatatggttgaaaggagaatataaaccattcacataaatggtaaataagtatttgtcatcttaactaaggatacaaaaaaaaggaagtgtgcatcaattataccatgatggattaattgtgctgtatggaaaaatttcctattaaggaaatttgtttaccttcctgaaaagtgtggctgaggttggtcacagagttgttctctagatctctttaaggatagattcctttttattttttaattgacaaaataaattttatttacttactgtgtacaacattgatgttttcaaatatatatacattatgaaatgactaaattttatcaaattaacatatgtattacattagatagttaccatttttgtggtgagaacactttacatttactcttttttttttaagaatacaatgtatcattaatgatagtcaccatggtacaataaatatctgtaatttattcctcctatctaactgaaattatgtatcctttaaccgacatcttcctaacacctccaatcagttcaatccaccattctgttctctcctatgagatcagcttttttagattctgagtatgagtgagatcatgcaatatttgtctttctgtgcctggattatttcacttaatacaatgtcctccaggctcatccatcttaattgcaaatgagaggatttccttctttattacagttgaatagtattttattttgtatatgtaacacatttcctttatccattcatccactgatggacactgaggttaatgtcatatcttgactattgtgaatggtgctgcagtaaacacggtaaacacggaagtgtaaaatatctctttgaaatacttatttcatatatatgtatgtatatatatgtatacatacatgtacatatatattcatacatatatgtatgtatatacatatgtacatgtatgtatgtatgaatatacatatatgcatgtatacatatatatgtatgaatatatatacatgtacatgaatatgaatatatgtacatgcatatgtacacatatatacatacatatatatatatatatatatatatatatatatatatatagtggtgggattgctggatcatatggtagttctgtttttaattttctgagaaaccttcacgctgttttccataatggttacactaatttccattcccaccagcaatgcacaagagtcccctttcctccacatcctcactagcacttgttatgttttgtctttttggtaaaagccattctaataggtgtgaggtgatatcgcattgtgacgttaatttgcgtttatccagtgattagtgatgttgagcatttttcatatgcccgatggccacttgtatgtctttttttgagaagtgtctattcagatattttgcccgttttttaatcgggttgttttgttgctgttgagttgtttgagttccttatatattttggatatgaaccccttatcaaatgtatattttacaaatatgttttcccataggatagatttttaaccgtttgggatggtttaagggaggccaaatggaaagcctaaaaaaagagcattctgtggctccatggtggattctggcatacttttttcaggatgctcttttccaggtcaatatttaaagaacttgaagaccgcaaagcttctgctcttgagatgagaaggagcttctcctccactaatgatctgaatttaacactggatcacttaaagccaggttcatttgcaaaatatttgctcagctttgatgctataaaagcctctccaaagctaaggaaaccctgagaaatggattattcatgtgactctgcagagcttggtatcaggcattgcttgtatttaatctttccctaagcattaacattctaagcttatgaaaaatttgtgacgtatgctaaatatattccatccagttatgatcagagtccagtcacctgagtgtaagatttctgccctttcagtgagaattgagagccctggtgaaggcagatagaaaagcccagaaacacttgttgttttatttatttttcattgagcctctggctaatttttgataaggtgtcacagatttaatcagttttagtttaaatagaagattgagaaatactatcttcttttcattaccattagaaagaaaccttaaagcttaattttgactgcatgaaatgatatctaacagcaaatatttgtaattggtgtattccagatacttgtagtgtaggaaatacaatattgttttctttaaaaggaaattgggtgtgtataaaacatcagaggaaacaaatttaaggcaagattctgaatgacagttctgtattctacaaacctttgctaatgaaagggaagatgatgattttcaatgtaggtcatggcctgaagtggagaatttctgaaattgtcattgcagaccctccaatcagcctgatctgtctctgcaacactcctgatgagctctgagccttctcagtgctatgagtatttacatcaggcagaggtgggttgggatccaaagcttacccaccctaatatgagtaagatgattctattacattcatcctagagagaatatccttcatagaaatagaggaagaaaaagcttgcatttggttaggaatatagattatgaagagcctccttatcytgaaagctgagataatatctgtatcatatgtggtaacaaaaaataaggttatttgtataaagaagttagcatataggaaggtatatagtaaagtgcttcataatggcaggaaggaaagaaatattgaaggaaaaatttaaaagacattgcgtcagttggtatctgtttttggcaagtaaacaaacaaaatatattttctcttttctgccagtagataggttaggaagcagctggaaggtaacatcgtgtctgacttctaggatatcacaccttcaatgagttattgttttattgttccttgggagcttccactgaacgtggtgttctgtcacttctgaaactctggggatttcttttcatgatagaaaattgacaactagtatttttttaatcatagaaggtaagaattgtgcttattgaccaaacatgtgatcaaaagtggttagaaagtctttagcaggtgtaccataaatgcctgccaccttcccatttccacacctccacagacagcttcttgtgaataccccctccacacatacccaaccatacatagtgttctctctgctaagaagaaaactgtatacagaccacatgacctcacctcactttcattctcctccgtacccaaagctgagactatggtggccagtcatttgtaagctgtctaggcacctttgacatggcattgtttgaaaagataagaggttatctttggggaatttggtatgaaggaacaaagcaatgagcagtgaagatgaaagtttatgtgacagaggctgagatagccatcatggggaatgatttaagctgaaattgtgggaaagtagaaagtatgactatgaataagtgtaatgtataacataaagacagatgatttataacacagagaaaatattacagatcagaaaatgaaaaagccaaaggggagagataagagagtggaatcgatttctgcgtaggtagagagtttaatataaagtagaatatggaatccttccatgttctccctcataaaattcacagaaacctcacgacttaccaaagatgccaagaggagcaggagatgctcttgtgtttcacccaaatatttgtttctcattttttttaatgaatgtgtgtattttctagaatgaatataaaggaatgcctcattcgtttatgtatttaaaatacgtcttgactaccaataatgtataacaacctctgctagactcaatgctaggtccagtgcatgcacttggaatccagggacccaacttggaagggctcacagtcttatgttaggagacagataaggaagcatatttatggggcacatgtgagattttgttacatgcatagaatgtgtagtgattaagtcagggtatttgagatgtccactactttgactatctgtcatttctatgtgttacatgctgtgatactgataaagacagggtatgtaaatgtgggagctcaaaggagggacatctaactccaacagtttgccagttgtggggaagaaagggtaaggaagtttcctcaaataattacatctgagcagaattatggcatgccagcaacctcagccaggtgaagggcaaagagaaacatttgcatgagagcctccagggaggtagagaatgcagtgttcaggaactacaacaacaacaacaacaacaaatcaagtattcctgggccacaagatgtgagagggggaatgatgggagatttgctggagggcagggggattcaaataaaagaccagcacacatgagctggtttgtgacctactacatagttttgacttgatccttacaacatagtattttaagttaaagagagagaagttcatatttgcagcggggaggtggataagtggttgttgagacattaaaatagtagagtttactggacttggaagacttagcactggacttggtaacttagtaccttgatttctggcatctcagtgagttgaggccacatgacaagtaggaggaagagcagttattatcaagagaatgcaaatgactgaaatgttgagttggggtttctatgggatatactggtagatagcagagtcagtagtaagatacaaataggtctgagacacaggagagaatctcaaaagggatattaagcttccatctctgtaagagccatatggttgggtagttggtttgctttgtgctatacaactatttgaagttctttacattttctttcctcctgttttttttttttttttttttttgaaacaagatcttgctctgttacccaggctggagtccagtggtgtgatcatagctcactgcagcctcaaactcctaggctcaagcgatcctcccacctcagccaactgagtagctgggactacaggcatgtgccaccatgccccattaattttttatttgtattttttttaaagacaggggtctcacggtgctggccagactggtctcaaactcctggcctcaagttatcctcccacctctacgttttcaaatctaaaaaaatagtttaggacgtattcaccttagagatttaagagtttatattttagcaagctgtaaagtccagaaatcaaattgtgagtgggcaaacaaaatcaaagcaagtttcatctcatttagaaatgtggaagaatgagaacccttagtttaccttgcttttgtgcatgcagagtgctagctgtaatgggttagcacaaaaagacaaaatcctaaatcacagtcactttgccataatttttaatagttatgttctctcatagttctatggatgacatgctcattatagacagtctgaaactgaggagaaccagggttcttcctacatgtttatgttgaatgtggagaaggtgaggttactgcttctgctgcccttttcagctcaacatttgatctggccaatgtggttagctatactgtgtctcctaccaccacacatactcagaaaactgtggtagtaaacatagaatgaacttccttaaaagtagaaaaccattcattggctaaggtacataagaataagaatgaatgatgaaaacattggtagaaatgctgatggaagaactgattgatgcagatctattttggagaccccttaactgccaggggacatgaattgcctggctggttgaattgactctagaaatgatgctctgtggccgctaagtctccatatttgaccaaaaggtgtgtgagggctgtgtccatttcatcacttgccatgagtcctcagggctagtcagaataccaggccgatacacgcttcacaagcatgtattgaatgagtgaatgagaaaatgaatacaataatattttcactagtagccatggattgaggataaaattaataagaagagcccccaggaagtccggattgagctttatgctctgggacactcttctgctcagctttgtggaataatttgcagcactagaaatggacttaacaaccaggatgagggggtcatgttttggggatcaaacctcttttcatcatgaaagctactgggtggcctctgacatgatgtgtttagttatcaaacatgtcagctaataccatggagagaacacatgtattaaaagtgacagacataacaagggtcaaagattaaaggtgaattgcaaagggctttttactgcatctctgttgttataacagtttctagagtaggttgaatacatgagcaaaaagaatgatgaggagtcatggtgagcagaagctctcttctcaggcaaagcaggaatttttttccccacattgagctaaatattctttaaatgctataaatgttactacatatctgtgctgtttgtgggacagcacaaacatatttgaaacattcagcagttctttctcattaacttccatttttctaattttcattggttatattttcctgattacagaagtagtattggctcattatcaaaaataaatgaatgaaaaaatatagacagttaaaatgtgatataatgtaatggcctaaatatgacattgttaactgtacattcctgcagttacaattgaagatggcattttatcccttaatcagatacaaagaactgttagaaaacttcctttttgcccaccactgcattgtatactgtggtatatatggaaattcccaatacagacatggaaatgataaataaacacaaggggaactctcacggcataactctgtgtctagcaggctaagataataccatgttgtgcagtggtggtaattagagcacatcacgtgactctgagtttttgagggcagtggtcaatatctttatctttgtatccccaagggtgttggctaaaatgttcagttagcactttgaatgagggaatgcttattgagtaaaaagtcaattacatgtgacaataaatgcagtaagaattagtcaagagaaagacaagtgtggcctgcagtcaccaacagaagctttaagctccaaggatacccaaatgcgtatgttaatcatgtgttattgttaaagcatttagatgatgatgtttggaagttgtgtgcaaaaccaggaaaaatttgaccaagttttggaagttcctttctgtttgatttatctgctgttatggtgttagggctattgctgttttatagatcagttctacactgtagtaattaactgggtaatgaagacaaaaagtatttagaaacactctgacatatcaagaaattagtgtcaccaacccagaggcttctctgtctcttcagcataatcttccatctcaggtatacctaaacttgggtgtttactgcctcaaaagcaagcatttcccttgaaaagcagatttcttcctttctttttttttttttttttttttttttttttttttttttttttttgagatgagtctcgctctgtcacccaggctggagtgcagtggcacaatcttggctcactgcaacctctgcctcccgggttcaagcaattctcctgcctcaacctcccgagttgctgggtctacaggcatatgccaccatgcctggctaatttttttgtatttttagtagagacggggtttcagtatattggccaggctggtctcaaactcctgacctcaggtgatccgcctgccttggcctcccaaagtgctgggattacagagagaagctccagcttttgcactagctgaatgttgttatacttcctcaaacatttgaggataaagacataatatgtgatagttttaggtgactttttgtgtgtaacatttgagctctgaggataataatatatctttctatataacacatttcaatatctatttaatgtgccagttgcaagaattttctgattgacattgatcattttcattcagaattaagtcatttccttctgggaattaatataatagatttattatatgcttatgggccttgtctaagctctcttctccacactgtttcttcaaatgtaattccattgaaaatctagctgctgttttagagattacagtaaggcaaagcatttctcagaagacaaatatagaacctaaagttactataatgacatttggcaaattatataatctgagttcattttttttctcttctctccctcctcccttgtcacaaagcctataggaaggtatactacatattttgacacttttttttttttttgctttcaatagctgtgttcttactcaccactttaaaataacgtctttcttatatcttttaactcagaggtatactcagagactggaagacttgaacggggactggctacccagatagagcccccttggtggtgttttccttggtgatatgatactgggccgtattccctcaggattgcagggtgagaactgtgtctttgctagcagactaggtaggagaggatccattcctcagaatcaggttcatgttaacatagttcacatattgtattaaatacaaaccagaatgccaagttttttatttacaatgagcaatatagctgttaaataggctatggcactcaagtcaacaacaattcacagactcctctccccatagagaagcaacatggggatccaaattgtaatcagaatgccaagttatcaatttataatgagaaatgcatctgtctgacgagaatgttgagttggcctgataaattcattgtctccctgtagattagtgacaggggatgccaaattttcggaaagttgcgagagaatatggctttaaaacaatgggaaggagttgatcttaatttctgtcttccaattaagatggttttaacattcccacctctacctggctggccttgccgagaaaacaatactgctttagtcaaacaatactgctttagtcgctgtgaccagtgtgggcaataaaatgtttattttctgcctttcctttttctttgcttttctcaaccaactacctctctccaaaaatgtgtatgacataattgattgggcttttgtctgtcatagtattgattcatcgagcctcaatcatatttcagccttccagccctagaattactcccatattattttttactggtgtctgggctatgttcatatgtgccaatcaaacatgtatagtttactgacctaacctcacatttgtttaatcatatcctttatttttaaattctgtaaatcaactcactgcagtccttggcactgaaaatacctctatttcttcactacatttcctgaagtggcaaaaatgccaagattatatgagacccagggggaaatatagtgttctctgcccctagtgtttaatgcaaattgaaactaaaataaggcttgctttgaaaaagtacaaaaataaattttaaaaaatgctaaaagctggattcttctcttttggagatggcaaagagatagtaaagttgataaagagatgatttgggaaatgcaggtactttttagcattagtgagtagactcatttctaacatctcctggaagtatttgtgaattggctccagaatcttttgctatcacctaccctacaattaactagggatatgcaatcaccaaatacagtttctgggacaccttcaaagatgtcagcttcttcaccataaagatggcaaaaagtagaataattacattctatctttgacctttgatgagaaatgatcagtttctttttctaatccaatatggcaagcacttctaattcgtgtgaatagatctctttatagacatagtgtgtttatatttaaatactaagataatctggaattctgaagctacaactgtataatgacattatacttggtcagctattgcttttcttttcccatttatttattttgcattgagtcctacactggtgaaaggcctggtgcgttgcattgagttctgcatgtttgaacttcacaaaggttcaaaggtgtgcacatggcctggaacgataaacatttgtcctaaagtcattcttcagcttctgacatagcttgtgatttaattgccacctcattaatatgggccactgggtgtgaatttgtcaaaacaagatacatcaggagagctgagtgaaatgtttcatgttcagaggtttttaccactcctgttccccactgcccatgttttgtaaacttttaacttcaagagactggtttaataaacatgccctgtcttctaggtcattgggttaaggatcatttcagtctttttgaacttttcacttttcctgtgtaagtataagctaagtacttattgggttctaaagctaaaagcctatgaagataaagggccttattgaaatagtgaagtgagcaaaatatctttatggttcctgaccttgtcctcctgggctttgtccttcttttaatgaatgacaccttaccctcaggttcccagtatttacacctttgtagtgtttttgcaattcagaaaaatgtatttgatagatgagtagggtgactgtcgtttacaataatctattttctatctcaaaatagctaaaagagaatagtttgaatgtttctagcattaacaaaagacaaacatttaaggtgatacatattccaattataccgacttgatctttacaagttatacaaatgtattaattcaccacgtgtagcccaaaaatatgtacaactattaagtatcaatttaaatttttttaaaaggacacagtgaaggaccatacttaaacttgattatttaattgctcatcatgaaattttatagggaaagaagaagaaaatcttcaataactcaaactcataagtaaagggacatacatggctgtatataaaggctatttataaagccctctatataaaagttatacatagcctataaaataaataaggatctgactttatattggtacctggcacaacacatgcattgcacacaggaaccactccataattacaattaaaattattatacacacaaatacatatttacttcttatcaaggtatcacatgttaatgctcacatgaagcagtatcaaaataccgccaatgagttgtagaagtctcttgctctattttcctcagtggcattctcactccctagtgaagtgtttttaattatttttatttttttatttttttactggctattttagactttctggtagagcactcaataatttctggatctgtcagagttaggcaatccactctgcaattggcaagatggggattttgctcatttatacttgactctccttcttctattaatcttctccttctatttatataactgtaacatagctgcaagctttaagtaaaacacgtaaagtcattttcttgttctgatgacttgcaatattttctctttattccccacgagatgaaatgaggatcttggtcccatacgctttccccaacttcttctcactcatttcaggccctacttctgtcaatcactctttctgtgtttagattgttgatatttgcacgttctgctaaaaatacaatcatctttgcccaaaggttaactttaaaagtagaacaataaacagtattaacattattatggccacataaaaatcatttaatgttaggtaaaaagtatgttaggattacatttttttaagagaccaatgtcatgacctctaactcactgaaaagaaaagattcctagcatttgagttcaaataaatgtttttttccttatatttagtcaattgcttaaaattaagctgcatttcttttatgtattctattttcctgcatcatatcttcatatatatttttttactctctatcatattatctagtctatttggtctgctttcccccactccaaatatatcccccttctagagtcgtctttctccctactccacactggacttacaactcctagacatcgtgctgcatcgctaatgtcctaagtttggtgttattggtgctatcaatcttcttggttagatctgatattttggtagcttcctattttttgaattatcctcttgttttattataatacatcctaaagtaacttcctaagagaaagcacacaggaggtaaatgttctgtttcttgcatactctcatatttgtgtgaccctttggccgacgatagaattctaggttgaaaagagttttcctttcgaaatttgaaagctctgctccattgttgttgatgagaagtcaagtactagttttattcctcctgtttccctttaaaaacttttaggagcatctcattattttaggtatttacatgttttcgatgacatacttgagaatcctttttgcacttattacaatatacactcaaggaaacttcttggtttatagattaatgtcttccattgagctatgggaaactttatttctatcttttctttaatatgttctcgcctccattttctctcttctctttctctgacttttaatatctggatgttagatcttccagacttatcctttctcatgacttctgtctttatactttagtcaaattagtgagagtccctttactgtgtttactccctctacttttctattttgtttattccaacaactgtgtttttagtttctaagtagtctttcttgctctctattttaattgtccttaccttctgtttttattttttggttataatagtttctccaatttgtgtaagtttattagagtatcttttgtctttgttcatttatttcttacactattcctgttttcatcttgcctgtcttagtctttatccataatattgccagatctcctaatatatttattattcttgctggtctatttgtatttaagggaaacaaaaatggcagactgcttttttttttatctaatagaactatttacacttaaaatctttatccttagtgagaactgtgggaatagaggaaacagagggaggggcaggtgatccaatatattaaagaggtgaaatttggcatcaatgagcctccaccataaaagaatgtgaaaattgctattcccagatgccaacatctaactaaagccttgcttttctactgggaattagttcaatttttttagagaagaacaaacaataatttttgttttgctttgttttggtttttggtttggggggttgcatgattattattttcttggatgattattattatttgcttgtaattgttcctgctgtttgtttcccaatatctcaaacggagatatttggctgcacaggagaacaacatatgtagctgtttcatacatggagcttacattgggttttgttttcagtcatatcttttatttctacccttggactccctgaagtttttgttattctttttatttctgccaaatctcccaccaatttcgtagtcaccttatagcatattttagactctggttttctgcctgttacgttttaaaatggagcagtaaacacaattatgaccacataactaagttaaaattgagtcaaaaagtgtgctaagattaggttttagatttttttttactttcagggaccaatgttgtgaacttcccatcacctatcttcatcttcatcccaaaatagcacaccctttcttggttattatgtacttcttttgtgttctgctaaactattatatactatacttatgctttcaaaataattcatttatatataattaagttttgtgtaaatatttaacatataaatatttagtagaatctctgaaaggagtgaaggcaaaaactttcctgacccataataattacatacctagagcatcacaaaatctattatcaatgaatggattctgaattctttgataacatgtctttaatttttaggatttaaagtacctcctttaaagcaccagaccagtagtcaattattatgatactcacctctgatattgtcttatccctgagtgtgtaataaacttctggtccctggaatttctcttccctcataaaactgtttctcaatgtatcattttgtgatgacttttttttctgagcttcctttacctacccaataggtacacattttttcccaagatgctacaacaataccagacaattccagatattcccgccttccacttgtgatctgtaaaatatatatactggttggttatgtgcaatgttttatgccctatgccctttcactggtgatgttttaaagcaagcattgtagatgaccatgaattatagcagacaggttcccagtcctatgctgtttcctaatgtacattttttctcttgtcacaactaggaaagtcacgtttcagtgttttggttttggtgaatgcccacaacaaggctagtgaaggaaggaggcatagtaggaagctgttggccagacgagcttttagaagacccttgctacatagagaggacgtagaaaatgtctttatcattaggtgagaaacatgaactgcattctttgttgcgtcatattaaaatgtaaatcacaagaataaattataaaaataaaacctaaccaaaacacaaacaggaggaggtaacagaggacagaacagagttcctagaaaattatattacaggacagacatacaagtacccaagagaaagcaaaattctaaaagtctcttagccaagtgtagagcacaaaagttctcctcagttcatgcactttcgaggcatgtcagttggaaaaagagcatgctataggagacagttttattgtgttttgtgcagtgaccttttaaaagggaaaggtcctttctgagatattttgagttcactcatgcatctgtcatagaatttgcttggaacgaagtgtgcctgtcaccccaacctttcttcagagcagagcctggcttcctcatgggaagaatgatgttttaagagtgtcattcagatggaacagaaagaggtcttctccaggtttgtcttgctactgaatcaataggatctcctggattttgaaaagtatattaaattttttttcagacgtcagagttggggggaactagttttgtttagctttatacaaatttctagcattacttgtacggatatgctggagattctgctgcctcttgcaatctgacagcctcatggagagttgaataaatggtcattgcctgggtaagtgagggctctttctaaagtgttcaagagtaggtcacatagagaggagtgccttcttcctgcattttttcaagtacctgttttcccctattttattcttttggaagggattgattttatggtagtccctttcttttctcacctcttgacagaatgtttttctaaatgattccttcagattattctttaggtcccattaaaagaaacatgctggttcttcattctcattctgtctttatgcttaatgcagatataattcatatttgttttatcaaagtcatttgataacctcttcaatgacaaatccctgattacagatgtattctcttttggtaacccacaggggttgaaattgctctaatttttggtactgtgtattaggttgagattaaaaaaaactttgaggacaatcttttccttatttaatatctggagaaaaaatactacatgtgagaaaggtggaaaaaggatgttgcactgtatgtaataaaagctatgaattttggcacttttgtaaactgtaaagatgtaaatgttccttaattattttcagtagtcagacttatgtttcttccagttgtatttccaggctgagacaatacaaaagatggacagctctaagttgattatcaagctttaaatatgtttcacttgattaagaacattgaaggtgagaatggaattatgtaggcttcactgagtatccgtaaagttgggaacaatgatatacaacacagaaaagaagctccataagaaaacagctgcaactaacccatctggaaagagacctcaatcaaaatgatacttagcgaaagaaaaatactttcagtgatcaaattatttgtctgaccaatgcttggtggaaagattccacattactagttatttgtaatgggtaattgcacaatatactgtattgttcaatctggtgtgaatgaaagtggggagatcttgacaattgtcttggaacaatagatgtaaaattgagactattctgggaaaaccaggatgtttgggccccctggtaatagtctaatcattatacatctgtgctataagcacacaaataacatctagtaatgaaagaaacattcagctaagaaaacttgcagtcaaaaacttttgataaagctgtgaagacttgttaggtcatgtattaatttaagatctttaagatggagagcatcccatcaatgattaggagaaacacaaacattttatattgtgtttaatacacttttttatgtttaataaaaaacatatcacctaccctacaactcataattaacttatataaagttttttttgtttaataaacatttcatattgtgtttaataaaacgcaaacattttattacttacaggtcctgggtgggggcagtacgtggcatgcctggagatgacacacaaggagatcaggaagtgtgggcagggagaatgtggacctgggtcacttgtatttattggagtccagggtgagaaacctaagtgtcatgggacgaggggagcaattgggcagtttaaaacaagcaggcacaaaatttcaaacaacccaacattaaaaaccctttctggcaaagaaatgttatctagaaatctagctgacccaaaggctgagtgtgtgggtttggggtaagagctatcttgcctcaccagagcaacaaaaaggagaagtcatcggctaagctagatagccaaacaaaatggatgctgaggcaacattaaattataagaattataaggtcaagatgggatggagattctggacctggtacaaggaagtgctgcaatgaatagcagggagttagggcagactacttccagtgtcctgagttttcaggtttcatttggctgtcaaaaccatttgttccctagactgtgatttgactggtgatgctggctggcagtgcccctactgatgacttagcagatgactctgagctgacaatttgccatccttcagctgtcttggtaggagggattcagttaccagcatgcacagcacagagcagaatccaacctcatagattttcaaaaacttatcgctaaagtctattattaacagcttggtaagaaaagtctttttcattgagaaatgtatagattattgtgaaggaaaagtatttgctaagaccagactggccgaagctaatccttttgggaatagccttaccaatttgggggaaatgactcatttacttataagctatacctgtcagcttccctttactacctttgacagctcttaaaccagcagtataagaactgctagtgaaaaaataaacattagtataaaactttatgtacctattacataacagtcatatattaggtgtccattttaagtacagatactgaaatagcaaaataatttattggagaaactcaaaatgctatagaaaaatttgacttggaaagcaccacaaatgtacatgatacaagtaaacttgaagaaaccaattacattgggggatagtcttgttttctgttattctgtggacttgctttattaatatatggaatttagagtttcttatatttaaaaaatatgaaaatgcacataatcattcccaggctgctcctgatcctttagtgatgattcctacagaaaaaaaaaaagtgcttgggatggggaagaactttgtggccatcgattttttctttctttctttattatttttatttttttattatactttaagttttagggtacatgtgcacaacgtgcaggtttgttacatatgtatacatgtgccatgttggtgtgctgcacccattaactcatcatttaacattaggtatatctcctaatgctatcccttccccctcccaccaccccacaacaggccccagtgtgtgatgttccgcttcccgtgtccatgtgttctcattgttcaattcccacctatgagtgagaacatgtggtgtttggttttttgtccttgtgatagtttgctgagaatgatggtttccagcttcatccatatccctacaaaggacatggctgcatagtattccatggtgtatatatgccacattttcttaatccagtctatcattgttggacatttggcttggttccaagtctttgctattgtgaatagtgccactataaacatacctgtgcatgggtctttatagcagcatgatttataatcctttgggtatatacccagtaatgggattgctgggtcaaatggtatttctagttctagatccctgaggaatcgccaccctgacttccacaatggttgaactagtttacagtcccaccaacagtgcaaaagtgttcctatttctccacatcctctctggcacctgttgtttactgactttttaatgatcaccattctaattggtgtgagacggtatctcattgtggttttgatttgcatttctctgatggccagtgatgatgagcattttttcatgtttcttttggccgcataaatgtcttcttttgagaagtgtctgttcctatcctttgcccactttttgatggggttgtttgtttttttcttgtaaatttgtttgagttcattgtagattctggatattatccctttgtcagatgaatagattgcaaaaattttctcccattctgtaggttgcctgttcattctgatggtagtttcttttgctgtgcagaagctctttagtttaattagatcccatttgtcaattttggcctttgttgccattgcttctggtgttttagacatgaagtccttgtccatgcctatgtcctgaatggtattgcctaggttttcttctagggttttaatggttttaggtctaacatttaagtctttaatccatgttgaattaatttttgtataagatgtaaggaagggatccagtttcagctttttacatatggctagccagttttcccagcaccatttattaaatagggaatcctttccccattttcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcatgatgcctccagctttgttcttctggcttagtgttgacttggcaatgaggactcttttttggttccataggaactttaaagtagttttttccaattctatgaagaaaggcattggtagcttgatggggatggcattgaatctgtaaattaccttgggcagtatggccattttcatgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttatgggtggataagaatgcttgtgatttttgctcatcgattttgtatcctgagactttgctgaagttgcctattagcttaaggagagtttgggctgagacgatggggttttctaaatatacaatcatatcatctccaaacagggacaatttgacttcctcttttcctaattgaataccctttatttccttctcctgtctgattgccctggccagaacttccaacactatgttgaataggagtggtgagagagggcatccctgtcttgtgccagttttcaaagggaatgcttccagtttttgcccattcagtatgatattggccgtggatttgtcatagacagcgcttattattttgaggtacgtcccatcaatacctaatttattgagagtttttagcatgaagcgttgttgaagtttgtcaaaggccttttctgcatctactgagataatcatgtggtttttgtctttggttctgtttatatgctggattacatttattgatttttgtatgttgaaccagccttgcatcccagggatgaagcccacttgatcacggtggataagctttttgatgtgctactggatttggtttgccagtattttatggccgtcaatttttgaccctgagagtgaacctcacctttggaagttactaccaagcatttgacttttggaagactctttacacagcaagagatctcctccacctttgaggtgaggacattaaacttggtttaaaaaattacttttccaagtacattaactatgtcttatatattatccatacacgattactaagaaaatataaacattttttcatatactggttaattggctttaaagaaaaaaatcccctttttaatcccatcaggatttagtttgacaaatttttcagaaacttataaagatgaaaacacctggatgtatttctctgtaaactttggctgttagcatcctttttcaatgcttgtgtagtttttcagaacagaacctaaccttcaagatgagtcatttgttcccaaacttgaattgtcatgaaacactccttgggtttccctcccgtgctgaatatgatttctaagaatgggatggcatggttactgtataaagatcatttgttctacaggtcagaaggcctgagttctcatcattaattaactttgtgatgtatgttgggtaaatcacttaacctctacagttttatcttctgtaaaatatgaaagaaagactttgagctaaagtttgtttctactgtaagaacatgagatattttatcttggtgacatcatggcttatgggcaggctgaggtgggattagtaattgcaaaagcagtggtcataaggtgaagaaacctggacatgacttcagacttaacctgggaaataaaatcagggaatgtggacaaagtcagacactactttagcacaggatgagatgccagaagatgatggatccaacaaagacatgcatgaaaggccacggggctgtttctgggcttaaacaagctagtcttaattaggagaaaaagcggagggactggaggagtggaggagaggaagtcaatagtgatgcagtacttccatcctagagggtttcttcgagagccaagagttccaatctgtgcatggcattaccccttctgaggtaaaagaaaaagtcctctacaaaaacctgacagtattctgccctcaagccccttgttaaccaggccaaggtgaggcatgggtttcatgccctactgatagcagtgcaagatgtcttgttatgagtattgatatcgaagtatgcttttaaatcatatttcactctgacaccgttagctacgtaactaagtcttagtgctattgccagtggtccaatctaaatgatgtagtagagaatctagttcattactctgagctgggactctgatgaagatgtagggtgacacactgtctttgtgaagaaggcatgtgtggaatacttggtgtctttggtgagatggcagaacttaaaccgtgaggaggatggcaatcatgaggaatggtatcaggaagtttttccagcttgatagatgggaaggaaagcagaatggcaggaagggggccaggtgctatctccttgaaggagggatgaaccgtcctcagggtctgtctgctcacaggcaggagacttataccagaactgtgtttactggaagtcttttagagttcaaagtgaacttatctgagtttgacaaataatcccctacagcaagacaaagagtagtagatgaattatacatttggatactgttggaaagggagaggtaaaatccaagttggaataaagcatatgttatgggagatcatcaatatcattgagcacgggctttgaggattagagttatgatgaagtataatagtacagaatcagcttgagacacagtcttatgtttgttttggtcatctgcctagaagtaaggtgcagaaaatgcttatactttgaaaagtcgtgaattaaatagaactttctagcaatggttgatgaactgggtgggtgtcaaaaatcaagacttcatgattgggaagctgtggggatggggaattttcttagaaaagagagagactctaaatggtgctagtggggtggcctaagccctgacagtggaatgggacctttttggaagactgcacctcggggtaaggatgcttgtgaccctgagactagcatcaacccatgatagaacccaagggtgcagaaacctatgatagaaagcaagggtaccaaaaccttgagggtgttggcagactgaggggcactcagttcacccagggacatccttcacctgagaatgacttttctagatctccctgcagtggttttgagaacctgagtcctagttgagccttctgtgatgccttccaagtcctagcagtgtggcgtgcccacacatctttctcaacaaaggatgcagaaataggaatgtaattagagcagttcatcctcggtagagagtcctttgtggttcccagctgggcagtagtttaaaggatagccctgtgaatctactcaaatagtatctttatttaagatgtcaataaaaggtagtaaacttgagaatctctgagaagcattgatccatagtggaaattacatgtatttaagtatgaaggtagtaaatatatattaacaacacattatatgccagatactgtcctgggtatgagctatagctggaagtcagagcggtacaaaatctaccatgggggagtttaagaccaagttttcaagccaaacggaactggattctactaatttccagactgatgccttggagaggttacttgaatttttctgaatgtccattttctcatatattaaatgaccattataaccttgctctgtaagactgcttgttagatgatataatatctttcaaatatctgttaaagtgcctaataatagcataatagctactcaataagtagccataattgttttaacaaatgaaatttagactcctaggaaaattagaaagtactgcactggctttcctgttttcctaatggccatgattatttatccagtgactcagtgcagattttgatttattttccttttcatagccaccttatcaaaaagtcctgctactgttatttctacttcaaaatgcatctcaaatctattcacctctctctgttcccatctgtatcaccctagtccaagctctcttactccctagagcaatagccggtaaccatgtgcttacaacacattctctgcaaaggcagcagagtgtattttttacagcatatatcagaccataagggcctcttgcttataaaggaccagtggatttttattgcatttactatccaaatctgaagttgccatcataaccagacttctctcattctcttccatgtcttctggtatcacattcctgcactaacctctacaccctgcgtcctcccacctcacctcagcttcaccgtgttctcagtttccagcacgcaccaagctctgtgccacttcgaggcctcacacctgccgatctctctgcctatgattctcttctctatgctctttgctgaaccacctccttcttatccttctgccctcagccttacctcaaccagcccatcattctctcagcctccaccgtagcacttctcatgactggtgcttgcttatttacatgttttctcttgcgcattggccaccacaaaggtaaattcttatctgttgtgtgttcaccttggaatttcccatccttaactcgataggaggctcttattaaatatctttgtaaataaatgatatttttatgatagataattgcagattacatgattgttcagttgttaactctgtgcagtcgtagagtattctggttttaaagattagcacttggtttatatgtgaatgaactttcaaaattagacacgatcttctcagttttcttgtcaaagactgtttctaaagatttgcatgagctagtctggtcctggctatcttcctatcagggatgcattcctgtattggtagattctgtagattaactttctaaatcattcatggcccttccttctgcgccgttaactaggaagtataaagtactttagaacatttcattattagtattcccaatatgaccgtggaaatgtgggcagtgggatgaggcaatcaaactgaggttttctttcatgataactatttttgaaaactacctgcagtgagaaagaattctcaagcaggtgcagtggtgtttgagagaagcataaatggagtggttgagcccagaccttggagtcaaataaacctaggtttgcatctcagctctgttgcttacaagctatgtatttaaactctctgatctccaaagtggttttggtgattcaattagatcattcatacaatgagagtcttaacaaatggtaagcatttttaacttttagaaaaacacaaggcagttagtagacgaagtgtatgaggacattgctagcttaatataaggttctttaagggtaaaataaagagaaagggaagaaaggcagagttctttcttttttaacttcttaaaccttttcttatgaaaagatatgccacataaccataattcatcctggcaattaggtaaacagtatacagaatatgactctcgccattaaataaacttaagcaaggtatctttatcctgaaggaattcttagagatttcatcatgagtaagcacttttcagtatagaattgccaaaatacaaaagaacaccagagaaccactctaacttctaaaaaaaawaagaaacccaaaaccttgtgattgaaaaaaaaaaaaaaagtaagaaaaagaggcccttagtcattctgttcccttttgggcctctatctttcatttcctctggggaaataaagttataaactgtgctggcagtaatctagggtgatgccaagtcagttacccacccccaactccatgtctccaaaagattctttaccaccctttgactctaattaaagaaaacaaatgtttccagttttctrtcatgtacctttccactctgaattatagaatagctttcttgaaattcttttaattgttttttacaaaggattagcattaaattcatagataaaaataaattagtaatagtgatcaaaatgacctaactccactttgtttttacttttcttctgggtaggagggcaaataacataactgcttatatggtgatttattttaaattgaatctgaatttctatttcttaaggcctcattggcttcatggcaaataagagagttttaaagaatttattgtgttaatttctgaraaaccaggagtttactgttgacaataatggcacaaattacaactcctacacagctctaccccctccacttttgagtttcaagacttttgccaaagttttctggtctttgttcacttctattattaacatctcttgtgtgaaggggaattttgaatgaatgggatgaaatcatctaaaccagcttcggtcctaaatatagtgtctggcatcaggtctgggaaaaaaaaaattggtcaaagagatagcctgaggttatttttaggaagttggatgtttagggaaattratactatgaaagttctggcctctatctctgaagatattccattgagagatacatgcatgcattcaacatctcgtttttttccattcctgcccttygggtgttccgcgtcattcactatcttgtcattacagcattaagcagaagcttgaggcagaagatagctaatgcaacgtttccatttggtcctgtaatttttctgcacagagctttataggatttcatttcgggttaataaggggaagttggaaccgaggagaaagcttatgctctgccaacatatactgaggattactaaacttggaggtagaaaatagaacacaggaataaaaatggaaaagtcctggcagatttctccgtagcagacttcatccttaaaaagcagaattccatccagctcttcttggtggcataattccttatcatggaattataagataaatgctctgtttttatgcgtctctcttttctaaagttgaattgagtgtctgaaagacagatgatgtgtctaataccaccgttgttttacagaagggaaatctaagaaaactatagctaccctcctgggaaaacatatctaggcatttgctaacagtcatttaggctgcatctatgcacttccacacagaaggataaatgtcacatgttcgttgaatgatccagatgtttcaaatatacagttgttttatatttggtaaacaatgcagttaggtcatgtaaattttaatttttcatttggagtttatccctatgcaggcaatcatagattagaaagttatttttttcatgtcctacctctttgaattgtcaggttcttttaaatgctgttatgyagcaataaataatattttatccataatcaaggtggatgacttactggatatcagatattattattaacaaaaagtttactacattgtacaartatcactagacaaagacaacctctagaaagttaattaaggtaactaaggttctcaactgcaaccacaaaactttcacagttaataataatttcacagttattaacataactttttsaagaggtactatactaaaccaaggatgctaaatataacttattaatttctgtgatggcttctggggatatcaatattggtatactttcctcactgcaatgaagacacttctgcatctacttttgagatttttttggtcatctttctagcagccagctgtcacctcttgctgctgtaacagttcctagtaatagttcccttattcttcaaacctgatgttagcagggaggtcagatactcaagcatgattagaattgtagaagcttgagcctcatatttaaatgtgtgtaaatatatgtttgaaaaagaattaatgagctcttaattgcagatcaaaggatatggtttgatagtgaagtggcccaatgaaagttgtttgaattttccttttgtctttctgtaaatggaactgtgttcttgaaagcctctacgtctttatcttgttcctcaagattcttagggcagtgcgtgtgggtcaggggtaggtrtgtctgggaattaagagtatctagttgatttagtagctatatttctcttctttagcctgtttattgggaaatgaaagacaatttaggctatttcattttcagtcagtgtctgttatgaattcattggaaayagcaatgtgaaaagaggaatgaatattgtagatttctttcattgtcatatttgtaaattactgggtgggatttataaacaaattattgactaattatgaacaaactgttgtttttttcttttcaatcaatatgaacaatcaagtgacctaacamatttaattttaaaaatagatttgaaaggtatatagtagttaaaacaaggccccttgattcagattgcctgagttcatatctcaaataggctacttttttgtggtgtgcctttaggcaggatgcctcagtttcctcatatgtaaaaaagaaatgttaatagcagcttaccttgtggggttgttgtgagtgggtcaaatgacctactatgtgtaacgcactagagcagtgcttggctggagtaagctccatgtaaatgttagtccttgaatgaaagtagagctctggtagagatattccataaagacaaccttaaacatttttgaaccttttatgcctccaaaatatacacttccaaactcttctatcactgaccatattacttataccctaacaaggaagttattaagaatcataccagagtacaggaataaatcatgccagtcaggaaaaggggtacattggttattctatttataacattacttgagtatttataacaacaagtaaacaaaacgttttttagaaaaagaagagattactgtgttgtacaaatattactagatgggtaatttctctcctttttttccaatgtattccagaacccccatggatatcaaaattaaatgctsaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagasggagtctygctctgtcacccaggctggagtgcattggtgcaatctcagctcactgcaacctccacctcccaggttcaagcaattctacctgcctcagcccccaagtagctgggattgcaggcacaggccaccacacccacctaatttttgtgttcatagtagagacggggtttcgccgtcttggccaggctggtctcaaactcttgacctcaagtgatccgcccaccttggcctcccagagtgctgggattacaggcatgaaccaccgcgctcggccacatgtttttaacttttatttttccaatatttttgatctatgattggttgaatttgtggaagccaaacccacagacatggagagccagctgtgtattgttattgtcatgtcttttattctcccctgttcttttctgcctaaatgccttaggtacttctttacagagttagatagcatttaccattgataccacccagagtggtgtggtttgcttctyctgaccctttcatgagcaaagctggtttcaggggaaactcagggatctgaacwgttagtaacactgattagaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcagcatgttattctgttarcrtagttcacgttgagtgtttgtattcatttgttgtttgtttgtttgtaagtaacaggttttgactaaaattccacggactgtggaacarcacacactggggtctatcggagggtggaaagtgggtggagggagtgggtcaggaaaaataactaatgtatactaggcttaatacctgggtgataagatagtctttacaacaaacccccatgacacaagtttacctatataacaaacctgccattgtacacctgaacttaagtaaaaaaaaaaaaaattaagtcatgtagatgcgtactttgaggtacaaccacgtgaatgattgtgccaaattattatgacagaaaagtctattgttgatttagaaaaagaattaacactgggcatcatttgaataatgggctttataaagaactgcacatattggttactggtagtaaaattcacagaatgttagatataaaaagtcctaaagggtacaaggaaaacttggtttgtcctaggtcaactagtaagattaatctacaacccaggcttctgactctatttcaacattcttctcataatgtcattgaggttacacttaataaacaacgttaaacactctctcttttaaaaaaaattgttggctatacatgttggctcacgcctgtaatcccagcactttgggaggctgaggcaggtggatcaccagagttcaggagttygagaccagcctggccaacatggtgaaaccccgtctctactaaaactacaaaaattagctgggcatggttgcaagtgcctataatcccagctacttgggatactgaggcaggagaatcgctggaacccgggaggcagaggttgcagtgagctgaaatcgcacattgcmctccagcctgggcgacaagagcaaaacttcatcccctcccccccaaaaaattgttaactactacaagcataaatatgaatatctacttacctgcatttctgaagctagaccataagtattaacagtgcttatatctacagtccctggcagatagtcggtgtaagaaatatagattaattgaatgaatcatatgatcatggttaagkttcttcttttgtgcgttttagcatttttaaatttttacattgatcatgtattgcttttgaaattttaaaaaacctggcaaaatrtaattacgatagaaactgacatcaaaaagctttgtagctgaaatagtgtaattttacactgagtttgaaacttctgatatcaggaactttgatgagcctaatacaggtgctatacgggatgaagtgaatatgcttagaatttttgatgaaaacaaatctgactaytcaggtttctctatgagaagggtaggcagtttgatttgtaattatgggaagctgaatgtgaggcttggatgaggctttgtcagtatcagaccagctccttcctattgggggctgaattcccttgggctctccatcagagagaccaacaggaagcaatcatgtagttcttccaacacactcagaagtcagtaggtccactccacaaataaattgtaattggccatatagtaaaatatttggtagtgttattcttgtccttttccatatgtacaagagagaaaaataaaacaacttcacatcctcctaagcaagtgatcgagtttagatatttgtcccctccaaatctcatgttgaaatgcgacctcctcatgttggaggtggggcctcactggaggtgattgggtcataggttccctcccagtggtaatgagtgagttcttactctgttagttcatgcaagaattgatggtttaaaagagtctggtgattctctcccctctctcctgcctgtgctctcaccatgtgacatgtctattcctccttcaccttccagcatgattgcaagcttcctgagttcctgaccagaagcagatgctggcaccacrctttgtgtatagcctttagaaccatgagccaaatcaaccacttttctttatgaattattcagtcccaggtattcctttatagcaacacaaaacaggcaaataccggagcaacagatcagaataaataacgctgagaggacctgacctgatttgctrtaggtattgttctagggtagcccctggtatccattgaagactctgaccgtgagctctgcctgcattaatataactggaccaaaggaaacagaactttagttttatgaatgggtgtctctccaaacaatttttcctggctgagctttgttcattaacatttttcaatttctaaagaacaaataatctccatttctctttttatgtccggcccactctcctgatagatataacctccctcctgtttagttccatgaattgtactccagctgcccaaacctgagaaaaggaattaatgactcattctctctgttgagtgagggcttattccagctggctcgcgctattctgtgtgtatggattctgtcagcagggttgaaataagatgttaactggcagttattcattaatttacagcaagaacaatgacttgactctatgtcaaccatttctgaaacattttgactaacatttttcctgttgcttagaackgaacttaaaagctgggacaggcatatggaaagaagcaaggatccccagttatgctgattggaactaggactaatggttttaacacagaatgtttatgcatgtagaatgaaatacacacacacacacacacacacacacacacacatacacgcacatacaaggggtcatactttatgtttgcattttcctctaaaagtatccctaagagtatttgtggttagtactacatttttttcatcatagtttgtttaaaagataaagcagatattataattattttctttacaggtgggaatgagttaaacaataattaactgaacaaaagcaatgtccaggtactgcaaaactttacataaattactcctattcattttcacagcaaccctctgaagtaaatggtattatcccaacttacagatgtggaaactartactaattaacttacctagaatcgaggtggcagagccaagacacgaattcaagtttctcttcctcaaatttaacattctttcttgtacaaatgtaaatgttctttaaaaatgaatacataatggcaggattcatatcaattttctgccagaattaccatgtttacctgaagtaaaatatgctcataaacaaagcagaaagtgcagctggtgcttacatctaggatgattaactggcatgtacagaatttttttttccttcaattgcaaagtgaatgcagtaaaattacagggcaatgggtttcttcccacacaagacaaggtgatctgaatgatatagaagagaaatgccacatgtggaaataatatatcaaggatttattaygtgtctgtggtcattcttaaggtcatttttgatgtctacacatttcagcatttgagaagttgtatattacatgcatacaaacccatattcaaatatacaattggctaaacaagtatttgttttaataaagtagtartaataaaatatttatagcaaaggrgacaagactcaggactgagaggaaaaactcaattaaaaaaaagacaacaatacttaaatctcttgatgcatctacttagcaatgtctacaatagcttttttaacactatcagaatatagagcataaattataatgtttatcctgcttttaaaggaaaatttttctcttatgcaatcatggtgggagaaaagaattcttaacgtgattatttgtctcatattttattttaggattctgttagtgtttttaggattctatcaatgcaaggtgtaagaacatgtcctggcagttgaaggaaagrctaaggaaaaagatgaaagagaagtgtcgcatcccttaccctccttttaaagaaatgctgaagttgctgagcagaargtgccacagtcatgtcccttaatttatccctcaaccttttccagaagtaaagtgactacacctaagctcagacagtgacagtcgtgggagaaaagctttatagraacagtgataggaataaaagtgtgtgcactgggatagatgtattttttaattacagaagtaactactaatctatataagagaggctccttccactctcagagcttccaacttaaccatctgtgaagagtaggtccttcaaaaccaactgtagcggcaaagttctgagrtgatatttccagactcagcagataggaacaggcatgctaggtgagatatggcagggaatattagtcagggttctccagagggacagaaccaatttgtgtgtgtgcgtgtgtgtgtgtgtgtgtgtgtgtgtgtgtgtgtgtgtgtgtgtgacagagacagacagaaagagagtgctttagtttaaggaattggctcacaattatggagactggcaaatctaaaatcttcaggctgggttggcagtctagagactcaggaaaagctgatgttgcagtttaagttcataagatttctgttgtcagaattctctcttgtttggggagaggtcagtcttttgttctattcagatcttcaaccgattgaatcagccccactcaccttatggaggacaatttgcttgactcgaagttcattgatttaaatgtaaatcttgtctgaaaacaccctcctagaaatattcagaataacgtttgacaaaatatccagggaccagggaccatggcccagccaagttgacacaytgaactgaccattacaagtctagttggcacccatatacatctccttaagccattcttaatctccaaatgtggtcacattctgaggaactggtggttasagcttcaacatatgcattttgaggagatacagtgtagtccacatcatggaggtagccctagaatttttttgtttccattcctattggcagagacaattgaggaaaagggaaagttccctttcatttattttactctcctgcacatctaatctttaaggagagaatagaatgagagttggggcacaaaacaaggattgaagggcagctgacttgagtccacgtagccccagaacaaagcaaaggracattagattagtggggtagtagagattaaagaagtaaacagaattgaaactggcagaagatagggtcattgtagagtggaaaaacatatctgaaacatggttgttaagtcataagctaatatttggaaagacagactccacttacttttttccaatagatatatatttactaaaatcttgggaaagctaagcttatgatcaggtgtaaccaggccatatcccttgggtcccaaagtcaataagcagggagagcttggtgtttaagtccttaggaatgggtcatgccactcagaaaagagaagagatgtttcgatctgtggattgttatcatctgcaacccaggaggctctttgattcttcatatcacgttatttttacctgaggattgtagataccctacagtcttaaagcctctggccaatctgccttggaaccacaggatacattaggcaaggtctggggctggctttgacaaaggacacagtattgctggcagaagaaatcactcttaaagggaatatagatgctactgtgagagactgatcaactaattaagatcttgttgaagattctcaaattgagtttgagcttgttgacaaaaaccaggcttaggcagagggatgatgatcctgagagcatcctatctccatcaataggagtatgttttcaacctagtggtttttttttttaatttttattttaggttccagggtacatatgcagatttgttatataggtaaactaatgtcataggggtttgtaatacaggttacttcatcacccagggattaagcctgttacccaataggtattttttctgatcctctccctcctcctaccctccaccctccaccctcaagtaggccccagtgtctctttttcacctctaygtgtccatgagttttcatcctttagctcccgcttattagtgagaacatgtagtatttggttttctgttcatgtgtcagtttgctaaggatgttggcctccattcttgccatgaaaaacaacaggaaaataaagcactacccttgagcatgcctctagaacttgaggttcaagaacaacagaagagtggcagaaaactatatcttaaatatattctttatcttttgtcagtcctcaatctggcaagaacattgctgctacctgacctcatagacatgcatttgaactcctacttttagtatctgctctaagatctgatttaagaacagatagtagaatagaataagcttggttctctaggtatcaattttcccaaatttcacagtagttctatgtacagtcacattgtatattataaaatatatgtttaactgtcacatgcaagtatatttcagtttttaaaagctcaaggtgcatgctgatagtcactataaataaataaatacatatgtcaacatctccctatccccaattcctccctcatcaaaaactaaataaagggcaaatgaataaataaataaaaatgtttaaactgctgaccttcctgtcaacaaaggtgatgtgagttacaagaatctgttttctagctggagatgtgggcgcagtcatgagtatgcctccaccattaacagcactaaacccaacgtactcacaaacaacagctgcatgaaaaggccaagcttagtatcatgtgtaatttatgagagcttgttaaaacacatacatgcacacaaagttgaatgaataataccaggtgatggttaggaaacagaaaattcctgaagcatctcttctttttaatgaagtatcaaaaatactgttttattaaaatcgggagaaaaaaggctttaggccaagtgtgttgggttggccttgcaactctacttcggttacaaatttaaaggccaaagagttagagattgtgtatatgggtatgtgtgttgcaggktggggtgtgggacatatcaatacaataggtaaaatgaatggtggattgtgtctgggataatgtggcatattttatctcaaatcccaaccttatctcccaataggagatttggatcatgagcaagatttggcttaggctagttttcaattcccaggattccagctccttcatagcaccacccttatgcttactaatcccttcatctttaagacacctggataatgagctatctgcatggttggaaatagtctgggtttgttctaaattttacattagataacaggtcagcaacaaaataatgggagggggaaattagaaaacattaagtcttatttcatgtcatgtgatacagtatatatgtattttttttaataaaagaaagtgacatatattgtagttcaattggatatttacatttcatgtagaccataatggtagcggtaattatagaaatcttagcaactttcaaaggaaatttttcccagcaagatgactgacaaaatttttgaaagtaatagagagaaactgaggcataaaatttacctgaaagcagtcctgtttaaattggacaaaataattaccttttcttacatccctcttttagagttttcctaatatcatttaatacatagatagtactagaaagaaaaagacattttaaattaagaccaatgtgaagcattataccmatttagtatcattttgcccattacccttatagaaactaaaaatagaatgagtgctcagagtttgtactgtaactgcctgccacttacatgggataactatttttagttccatcgtccttattaaaggctttcattatgagttcatttatggaaatgttatctcacagagttttttttggagacttttctgagatctcaaaatgaggtctcagaaacatgattagaacatagtcatttagtttcccagcaaatgctgatcctttccaggaaagttctataaataaggaaccaaagctggttgtcagtaatttgaagtagctgggttggaccgtgaatattaatatgtaaattatagcttgtgccatctatacacaaccaggattgtatgcatatcttcccatggtttattttmagtctgaatttgcatacaaacactggtctaattgagtttttaaaaaaaattcttaagagatgccatgtgttacttaaagatgttttgttttgaaactttgtgataggtaagatccactaatgtttgtaaaatttaccatttgtaggaaatattctattctcagtaattcctggtgaaagtggtaggtgggttagagatcataaaatccagtcttcacgggaccaagctggaacatggctgggtagctggtggggtagtgacagccctgcttcaaggagagatcagaaatgagggatgagactgagtgcaaagtcaaggtcaacacaggctaatcttggcttttggctacttttctgtaaagagtaatgtttctctatttgaaggagtgattttaattcagaagtatattggaaaagtgaaagaattcctagagaaaagttaatcccagacaagatagtgaatgacatatagtttattatccagtgacctttagcacaacaactacacatatgcgcaagcgtaactgctgggctgctctggagttcgccagaaaccccttgcccttagtttgaaggagggaaagaaatatctgtaattattgctctatatcctttgcttttgacataattgattctctggcatttaaaatttatatccactcgcccataggattcttttaactctttcattgtttatttccttgtataagaacaggtctgctagtcagagagaatgttgagtatctttcataatccttgtctttatgggaccaaacatttctgccttgtgctagaaagatttttcagcccagccccaggcaaccaccattcattctactctctgcttctatgagtttgactattttagttacctcacaaatgcttttgctgcatttgttttgtattttaattacaccgtttgatggcaatgctagaaatttaggagctacagctcctctctaacatgaatgctatcttgtcaatgccttcagaagaataaagatcataattctttcttttacattgtgatttctataagaatagtttcctatcttcctggatctagatggaagatattaactttcagactaactgttcactggacaatttttctttcattattcctaaggtctttattgtacatatgatggtgtctccaatagttaaatatgcctctaactacaacatataatttaaactcatacctcacctgggattatattgatgatttttggttcaactatttctcaaatttgagatgctattcagaatttaagtgaggtctaataccataggcagggattagaagtccaggccagaagtctgaagtcatcagcttgggttctgttgatgtgaagtgaattggatcacacagagatagacatggccacagtcaggtgtgatacttgatgtgcctatgctttgcctcttagccagttcttagtcattccatgcaccgtgctccttagtagaagagagaacccttcaggtagacttctgtgaaatcctcacaaggcacagaaatttaatggcatttctgagagtcacaagggttctgtgaagtagaaattatgctctcattacattagcttaatgctgagtatattgggactcttgtaaatggacattttgttcatggatattttgttttagcaatttaaagaatgttaactagcttaatattttagagtgaacattttaaagtgataaagaaaaataagaaactttcttatctcaattaaaaatatatatgtatttttggtccacacaaatcacatcacccaaataaktcagagcactttgctagaaaaggcaagacaaggtgtttctgagagtgtctccgcatttagatagactatttagttccatacttagagatcatccactagggtttctttgagcttggtgaagaatattcagcaacttgcctaagctctgggaatgtgagcatcagttatgaatataggtcatctcagtttgtgcacagcacaytttctgtcagtccaatataaacttgtatgagtagatctgtttattgtgataactacaacttatattaacttgttgacatgctttttctaacttattttcttgggtctgcatttttcaaagatcaaaatttctgcatcttcagcacaagtagattgaagaacacataatacggatagtgattaggaacattcaggcatggggaacgggtgacatattgtttactgtgtttaaaagatgtgttataaatttcacttagtcaaactaacttgatgaaatcaagatagcctatgaggaagaataagctctgcaacttacatttttatatgggaagaaataatgagtcagtcttcttgaagttttttacattattatagtaagaacatttaagatgagatatacccttttaacactttacattttaagtgttcaatatagcattgttaactctagataggacgtttcatagaagatcttagcatctgacgtaactgaaactrcatgcatcgaatagcatctccccatttctcccacttcccagccccaggcaaccaccattcattttactctctgcttctgtgagtttgactattttacatacctcattgataatggtttggatgtttgtcctctccaaatcgcatgtagaaacatgattcccattgttggagatggggtctaatgggaggagattggatcgtgggggcagatccctcatgaatggcttagtaccatctscttggtgataagtaagtttttgctctgagttcatgtgagatctggttgtttaaaagtgtgtagcacctccccaaccgatctcttccccttttgccttccaccatgattatgagcttcctgaggccctcactagaaatagatgctggagccgtggtggtacagcatgcaggactgtgaatcaattaaacctcttttatttcttaaattacccagcctcaggtatttcttttctttctttttttttttttttttgagatggactgtcactctgtcactcaggctggagtggagtggctcactgcaaccttcgcctcccgggttcaagcaattcttctgcctctgcctcctgagtagctgggactacaggtgcgtgtgcccacgcccagctaatttttgtatttttggtagagacagggtttcaccatattagccaggctgctcttgaacttctgaccttgtgatctgcccgcctcaggctcccaaagtgctgggattacaggcgtgaggcgctgcgcctaaccatatttctttatagtaatgcaaatggcctaacacacttatgtaagtgaaatcatgcagcatttgtcgttcttgactgggttatttcctttagtgtgatgtcttccaggcacatccacattgtcgcatataatgaagttttaataactgttctaagacttagctgaagtcaaatggaatgcttctggtacttccctcatagcttatctcctggccttgactatggccatttcctattcccaccctgctctccaaggtggtattctagccatccttcaaggtcctgtgcgaataccatctcctctaggaaggcttcctttggtttcaaggcagagttcaatcgtaccccatctgaaaaccaatgacactttggagtacctcatgatagcccttcacaaacccctttaatgtgactgtgtgtgtatcgtctctctacagtgagaataaaagctccaaagccaggaactatatcttcctcacttcctcattctccacgggaccttgcgtttaataatttaacgaaaattcaacaagtatctgttgatggataaataatcatggaaaataaattccagacgaggtcagataaagtggattatatgggtaaacattgtggaaagtaagcttttcgaaatattgtaactggtgaaaagttgtccatcatagttaatgggctacctgagcaaatacctttcctgagctttttcttgaattcatagaaacttgggtctgaaagaaaacttacaagtcatcactttttttttttttttgagacaaagtctcagtctgttgccaggctggagtgcagtggtgcgatctgggctcattgcaacctccgcctcctgggttcaagcgatttttctgcctcagccttctgagtacctgggactacaggtgcacgccaccatgcccagctaatttttttgtatttttagtagagatggggtttcaccacgttggccaggatggtctcaatctcttgacctcatgatcctcctgcctcggcgtccaaaagtgctgggattacaggcgtgagccactgcgcctggcccaggtcatcacgtttagcctctcagtcctctatgttagaaaacagtaatccaaaaaaaaatgatttctttaatgctagatagtggctgaagtaggactagaactcaagtattttaaagcctgcttcacatttcttgttactaagctgcactgcctcccacacatggcctattttggtctctaaactgtcatgaaaacagatgctaggtccctgtcaaaatgtttgtgtatttctgggtgtgaaaaggtatgtgtgtgtatgtgtgtgtttgtgtctgtgctcatgtgcatggatccctggtggaggggagagaaaggcaatttgtagctgcagacttctgtcattgcacgcagcgcactctgccatggtgagttcatactccacagcaacagaacagctgctgcaaagggttggtgtgctattttcatcttgggtgtgtgttttgcatcaggctcttggcaatggcaagagtaaacctctgtaaagaacaccttcttaaccttttactgttacccacacttagtcaacagaaacaatatgtttaacaggagtttttcctgctggacagttaaatatgcagttcttgcatatgaaacatgaatattttgttcccttctgtggaatagcaataataataacactactagtaataccagctaaaatattttaagtgcttatttcaaacggaaaattttttttttaaatgccagattttttctctctagggcaacagtcatcttgtataactttgaattcacactaaaatcctctgtagcaacataaagatagaaaaatcctcctttcagcaatatggcactgtgtgcaatgagcaaatgcaatgatatagaaggaagattgagtttaagagtatcagcagcaaagtgacagaaacgctcatacattaaaaactaaaaattagacttaattggttataggtgggaggagcctattacttttggtgaggacacatataggtgggaaaaagagaaagaaaaaaagaacatatctatgacaggaagcttcacagatttcattttcataatactttttgagactaaaggaaatagaacattttctgtcatatgtgttccaagtaatgtcattctgtttctcatttgtcttttgacctggctgtataatgtatgtggtgaaacagaactcctttattattaattttttagtggctacattagtaactcttttcctgacaattatgaggaagctcttgtatattgacaagagcataaatctatcaacagccaggttcatacatagagtccacctcttaaaggttataagatactgggcaagtcatttcatttctttaaacctgtttcctcatctgtgaaatgctgatagaatcataccttacatagatcagatgtaaataaaatagtcgtaagttagcgctcaggaaattayagtattctgtgcaaatcttattaactttgattttgtttcatatattgataaatttacatctagctgaaaatacattgaatcattgtcatggactaaattttaatatgtcttaggaaaagagtccgggttgaagtgcagtggtgcgaygttggccccctgcagcctccgcctcacaggttcaagtgattctcctgcctcagcctcccgagaagctgggattataggtgcatgccatcagacccagctaatttttgtatttttagtagagatggggttttatcatgttgaccaggttgttctcgaactcttgacctcaggtgttctgccggcctcagcctcccaaagtgctgagattacaggcgtgagccactgcaccggtccaggacaagaatatttttgaaactatgagctttatcatcagagacattaaaacttcagaaggaaagagacctttgagttcttctgagccaactccttccttttatcactaccaacaacatgaagtcagagggaaatgacttgcmtacagtaagatgagcaggaagaagtgaaagcagattaggggctgaggtcttcttagtttatgtccagagatctttccacttcacccaccatactctacattagtcactaccacgaccatcatcatcattatgaccaaaattaaatctaaacaacttttcaccaagtaattccattttcatgctaaagatcaggcagttcacttccatttcctcttttgtcagatgaaggaattgggccgggcgcggtggctcacacctgtaatcccagaactctgggaggccgaggtgggcggatcacgaggtcaggagatcgagaccatcctggctaacacggtgaaacctgtctctactaaaaatacaaaaaattagccaggcatagtggcgggtgcctgtagtcccagctactcaggtggctgaggcaggagaatggcgtgaacccgggaggcagagcttgcagtgagctgagatcacgccactgcactccagcctaggcgacagagcgagacttggtctcaaaaaaaaaaaaaaagaagtaattggatgaggtgatttatgtaattcctacaacctctcagtgctaacaaagcaacattcaatgacatttacaatgatcatggtggcaagttgggagagagaaagggcatttctgaagtaataataaaatgagtaaaataagatggtagtgccgtgtgttgatattgtgaactttacatttttactttctctcatccaaatcacagtaaaggagctgaaataagattttagttaattggtagccacacatgcccacaggctggtatgccaggctttgtttttctcacactgctgtaccatatccaaggccagagtgaatttcaggtgtcatgggctctacaagggcaagactggagtaggagctaaagtcaagttcccattggagaggattgaccaactgatagaggatggaaacgaagagccaaaggggagaagggacaggaagtactgagatctgaaagcaaattgcctaacatttagaggtgagaatgtgaaatgaggccaaccagggctggtgcagagccagaacaagggaggtcagaaagctaaggtgaaattctggaaataaatatgatgagagcttattgtaggggagacttttgggggactatggcctcgatctgatgkgtctgcttgtccccagtgctccttcaaacatgctccttgaagcttcatgcctgccttagacagccagagattgaaaatgaacatatattttgaaaacaaagacactaagaccattcacaaaaattcaagaagtaattttttaaaaaaaatacagtaacatttaaaaaatatatgttatttcacaacatatgtaaaaccattaaaatacattgacatcccaacacatattttggggtgtcaaaaaagaaatatggcagggtgcagtggctcgtggctgtaatcccagcactctgggaagctgaagcaagaggatcgcttgagcccagttctagactaacctgggcaacatggcaaaaccttgtctctacaaaaaatagaaaaacttagctgggcctggtggtgtgtgcttgtagtaacagctgctcaagaggctgaggcaagaggattgcttgagcccaagagtttaaggctgcagtaaactaagctatgatcatgacactgcattccagcctgggtgacagagcaagaccctgtctcaaaaaaaaaaaaaaaaaagaaaaagaaaaaaaatagaaatagtatatgttgataggaagcttagtgaagaacattaaaaagatttgcttgagctcttggttgccatggcagagctgcgggagctccgggctcagaagatggtggactctataaagaagcctcttgagggagttacatctgggagttgtaatttttcatgttcagcaccagatgttttgaggacaggcaggtgtttatgcagcaggtgtggcagtgcacagaggactgccacatgcctctggctcaagaccaagccttgaggaccacggagataaagaagttccaatgccacctgtcccagtgcaccatgcattgcaacgacaaagccagagattcactagatgcagggagtgaggatctttaggcgaagtgacagctggacagttgtgtgaccaagtgttgatcacatgcatgtcaccctgacaatgaccaaggagatgaaggagatgttctcatccactgggatacgtatcttggccagtaaccatcagggctgaggacaggaatctgtttaacaaaaggaaggagaattttagtctttaaggatgtggggaaaagaaagagagatcagactgttattgtgtctatgtagaaagaagtagacgtgagagactccattttgttttgtactaagaaaaattcttctgccttgagatgctgttaatctgtaaccctagccccaaccgtgtgctcgcagagacatgtgctgtgttgactcaaagtttaatggatttagggctatgcaggatgtgcatagcccgaraaacacccacaggtgtggaggggcaggccaccccttcaaaggcaagtgtcatgaatgaagaaattaaggatagcaacaagtataaggcctatgtcacttgcctttggacaaaggtccctttatatttcaatcctggaaagtgaaatgaaaaaactagtgctaaaattaggatcaaagatagtacaggaaagtgtatttaagtcaaaatttcatgtggcaagtgcttctcctggcagcaggaatatccttgtaccaagccagagccttccaaggtacaagttctttttcactatataggaaccgacagactggcagggtcctctaatctggctgtgatctggtggagtttgaggagaggtgtttctgtttggtgtgaggctcctgtttaccagaagtgttgctgcaccattttccataaacaataaaacaaaatccatgagataattcatttagtggggcaaaaaacgtttgttggtctttgttttgcttggttttgttttatatgtacaagggcataaagttgacttaggatgtggagttgggaaggagagtagtttggataagatctttgaaaggttgcttatgggtatcctttcctggtcatcaagatgtggatgtrcctctcttgaaattcttactcactgcatctttcagcctggatatgatgcaaaaacatgagcggtgacttcacatttaggtttgaaagcagagcttccctcttattggctgatggttcctgaggatgtctgcagcagagtggcaggacaatctagcagaaatattttccacttaaagagatagggggtttgtgtttggatttggttctgatatatacctgtatccaggaataaacagtgaaagaggaaccgttggctacataattatgagagttgtgaagtgctgaatttggaaaaacccggctttcatagaacagaatggaatgaaagcccaaacccagcattgcttacgtagcccctgaattaacagaaccctattgagataataccctgccaacagcaaggtcaaagaagaagaagtaagcgacttggctaggatgagctgtgacttccttagagcaaaggaggggcagccccattaccaaataccacttttgcccaggcttttgtgacatgcagtgctcctgcccagcatggcaccttattttgacaaggaccttgttatctttccaccaagttatcacttgaaatgataatatagcttgtatgttgttcccaagctgtcgtatattttcctggttgtttgawtttaacaatgagaataataaggtttaatactcctccctaagaaaagatttgcttatttcccaatttgaaattactttgctaagagggatataatgagttctatagtgaaacaagtatgtgttttatcctaatttctgaaattattcctgaaaattcaagtccattgtttgtctcccaccctatcctttggttctgtcacctcagaactaacaccttgacaaagtgtttcttttttgtccttctaccctccccgcaaaagtttattttttaataaatcgtttctggcaccaacccaaaccacaattacttaaaaagaaaaaaaaaatagcccaggattccatttacttataaacttgctttctgaactttatttttaatttcagcatttttttttttttttttgagatggggtctcgctctgtcgccaggctggagtgcactggcgtgatctcggctcactgcaacctctgtctccctggttcaagcgattctcctgccttagcctcccaagtagctgggattacaggcacacgccatcatgcccagctaatttttgtatttttagtagagacagggtttcaccatgttggccaggatggtcttaatctcctgacctcgtgatccacctgcctccgcctcccaaagtgctgggattacaggcgtgagcctctgcgccgtgccattttcagcattttttgatrtcagttatgggttcattgttttcaatataagataacatgagcagagactgtgtaggtgggattgagagtgaagactgggctcattgacaacctctcatcatctcgtcaagcagagtttcccatatcctctgaatctatgcctgtgtaactccaaatattagcataaatataaaaaattcatccatttggatattttatctacatgatattaattattgaaatgaatctaaattcttttcacaatgattttggcaagaagcactggcttggagtaaagtcagaaaacatgacacatagcaaacatttatagaccatctttttaattgtccatatgaaaagaataacatctagctgattagatgtattttaggggaatttgggaaagaataaataactctatgccttatgactgtcctgatatctgctatttatatctctgttctgggcaaagaacaccaaaaccgaatgaattaattgttgtgcatgctattatgtcttggatatagtaatatcaacatttatacaaatatcgactcagtacagataaaaaatagaaagtaattttcatcttttgtttttaaagaaggaaaaatattattatagaccctgaaccttcttcttcactgaatgggaggaaataaaagatatagaagcctgaggaatataaaataataagaaggtaatgtgatagaaagtggctgaggctatgtagtttgaatctccagaaaaggcctctctgagaaggagactttgagcttggagatctgagtaacaagaagaagccaaccatgcagggaacagtatttcaggcagagggaatagcaagcacaaatgctcaggtgtgaatgattccagctgtggtagccagagtctatgatgcaagggctaggaggggtggtagtgaaaggagtttgcattgtatttgaacaccaggaggaaaccaacacgtagcattaagcaaaaagtggtatgatatgatttatagtttcaaaagattacaatggttgttctgtaagaagataccagaagaagcaaggagaccagatgtggctattttaaaaatttttcgttgatacataataactatacatatttatgggatacatgtgatattttgatatacacatacaatgtgtaatgatcaaatcacacacttaacatatctgtcacctcaaacattatcatttctttgtgttgggaacatttcagatctgttcttctagctatctggaaatataaaatatattattgttaattatatgtcttaggctgtttgtgttgttataaaattaatttataaagaaaaatatttatttggttcacgtttgtgatgtctggaaaaattcaaaattgggcatctgtatttggtgaaggccacaggccacttcccctcatggaggaaggtatagagagcccgtatgtgcagagattacatggtgagagaggaaacaagaagggaacaggaggaaactagcagaggaagaactcactcttagtttctgcaagaggaattaactcactcccgatctccccactccctgggtaaggcattaatctatttatgaaggtttcacatctatgacccaaacaccttccattaagccccaccttcaacactgggaatcaaatttcaacatgaggtgtatagaggcaaacatccaaactgtagcactatagtcactcgaatgtgctgttgcacactaggacttatttattccttctatctaactgtatgtttttgcacattaaccaaactgtcttcattcctcactccctcatccttccctgccttcagtactatatttctactctttatcttcataagattcacttttcagcttccacatatgaatgagaacatgcaatatttgtgcttttgtgtcaggcttatttcatgtaacataatgacctccaattccatctatgttgctgcaaatgacaggatttcattctttcttgtggctaaataatattctgttgtacacatttaccacattttctttatccatttactcattgatggatatttaggttactttcatatactgttattgtgattagtgcaacaataaacataggtgtgaagttatccctttgatgtgcttttttccttttctttggatcagtccccaaattgagattgctggatcatatggtagttctatttttagttctttgaggagtctccagactgttttccttaatggctatgcaaatttccattcaacagcgtataaaagttccattttctcggcatctttgtcagcatttgtaaaattttttttgtctttttgataataaccatactaactagggtaagataatacctcattgtggttttgatttgcatttcccaaataattccaggaaagagatgacattgggttagattagaggggaaccrggggatgagtacaaaagatgaggagaagttagaatctattttagaaacagagtcaacagaactcaccaaatagatgcagttaaggaagcaaggaaagtaactaagggtaacacctgtttgtggcttaagtaactgaataaatgggggtaagacaatatgagacagcaaatatttggggaatattttatgtggtatttttggaaaaaggtgaaaatgttattaatttaaaatctattatgcttccaattgaagatgaaaagaattgcctagaaaagtctggaactcaaggaagaggtcagggctggagatataaatttagaagacattggaatataggtttaattaaagccagttggccagatgagatcctccatgtaaagattatagatagagaagataagagggatcaaaaccaagccttggggaattccagtattaagagttgccagagaaagaaaccaacaaagacagaaaaagcaatcagtacggtgggaagaaaccaagagggcctgatgtcataaaggcatttcaggctagagaaagtgtttaattaaagagaagaaagaagaacttccattgcatttggcaatggaggtcacatttgtgatctggacaggatagttgcagagagtaatgagtttaagttgtacatcaaagtaaaagacacacactctggccaaaggaacagccacagaaggctggcatatgatgtgcctggcacgcaagttttggttttgtcctttggattctcctgttagatatatgtggctgttaaacaaggtctcagaaataacggcttggtaatggatgattctgacaggatacaagaaatcccagagtgttaagctcatcaggtttattgttagttcttgtttcctggaagtgtttgaagccttgactctattaggtgaaatatgactccattaaattgtctgacattttaatactttaatttagtgccagggaccacttttagtgtaaaatgtttcacagagggttctattttaaactgcctggcttttgtaactctcagttttttcttccaagcctttcaccagtgtaaccatcccaaatttgcatcttgtctgatgctaactgaggaagaagggcacctggagtttgaccagcaggaacaaaacatgttaaaattgttgcagaagatgatgaggtaaaaacacatagcactggggcacaaaaccctggagcctggagcctgttgcaggtgtttagcactgaccttccacataaccatgggtagccataggacctctttaaccctcagttttcacatttgtaaaggcagtgagcaggaattgcattttaaatatacaattgttgtcactggtagcatctatctggggccagtggcacaggagtaaagagaatttacccagacagttgtgaggaaagaaagccatattgattagagaaagcatgaaaatacgttgcaagggtgcaatgggcaaatcagcaagataggagctgactgcaaggagacaaaggcttgctggggattttatgggatggcgcttgtgctggggagggctatgtgctttactgataatgccaaagttgtagtaagctaacttgcagttttctattgtctgagggtctgatagtaagttgggcatgagaagattgttagtaatttgcacagaagggctatgtgtcctggaccatgaagaaaggcagacttgtagcttatctgctttttctttttggtttctcctgctcccaacaacctgactccttttctctaattaggacttcacaagtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacatkktggatggaaagatgagacactgaaacaatttgaagattggaaggtgagagtctgaggtccaaagctttacaccagttgttgaagaaccttgatcacaggccagccaggacctcaaaggctcaagagaaatgatgacaaggtttgcttggcttatttagagctgggctatagagcgggaagattgtggttaaatcttagcagaactgataaaaagcatgaagttgtactgagagatttttcaactgtacatagttgcagaaagaaacaacctgctaccatagtaaatatttgtgttagaactcagtggatgaaggtggaggggggaacatggactggaggggctaacagagtatatgtagtaggcaagtgggattggagtacaagggaaggatagctgggggtgacgaggttgagtctgtgaatgagaagggcttaggtcaatttctctttctacccttcttccagctcttctcctccctctttattcctcccctcttccccttccccctcttttcctccttccctctgcctcctctcttcttcctcctttctgcctttactttatcctttaaagtcttaaaaaacaaaacaaaacaaaacaaaacaaaaactgtgatgatagaacccaaagtgtactgagagatttcttaactgtgggcaggattgttaagtggtagtaaactcaagacaacatttatattgcactttacaatacataaagcactttcacgtaattaactcctttgatttgatcatcacaacaatgcctgaggctaatagttataaaccttgttactgatgaagaagctgaaattcttatcagttaaatgtgttgctttgggcttagtaattggcagagcaagccaagtctgtctccagaccccgtggtcttctggttccaaattccatgctcttctcattatacagcacaatactttttttttttataaaatgggaaagtctttttttttaatgtatttacagacagttcatggctttagacacacacacaataaagccatttttattaaatataagaaagtggagcaaatttgcgtccttttttattttctaatgacaatgctaaaagctaaaaggcaattggccattgacgggagaacaaaggaacctgaataattgataaaatgtattctaaatccagaaactgtcaaagtaggcgatgtcagagatgctgcagttgcttggttgttcgtgatatctgatgacgctgcatctcagtcataaaaacttcagggaatctgaaagaaataataatgcgccatggtattttgagcttatcaccacaagaaatactctgtaattgcatcaaatgattataaatggcatattttagggacataataagcaatgcaaaggacaggtctgcttattagtgccaaaatttgtatttattcccatrttgctttttttttcctaggcattttccggcatctcatttctgactattaaattataccccaaatagaatatgtaactacatgtaaccaacctattttggtctacattaagtgcagcagcataaatagaaactgaaaataatcagaagcatttagaatttcgtttttattcatctgatttacttggccttttgtctgggatgtaagtgattctgagcccctctccagactcacactttccccaggtttcagtacctggggctcacaatctcagtggaagagtttcaaggcaatcttccactcaggactccttatgccttgcatgcacacaaagcagcgttgctcaaaacataggaaacaactatgaggaataaaaaggaaaagcttgttccttaaagaacgagaaggaggccagcagtctttttcataccttcttgtttatagaaagcagatttttttttttttttttttttagtaaaagcatatttggagcaggaaagaaatatgacctagactgtgttgttttcttttattgtatctacaaatagtttagctgaagtgagcttttcagttattgattttaaatcataagtttaattcgtcatcaaggcaacaacaaatgtgatgtttggggcagatgcaaagttgaagtatgtctaaagaaatagcacgctagttgcgtttaatgtggaaggtaaattataacaaaacaaactaaaaccccacaaactstaaagattttcccttatagttatagaaattaggaaatgccctawtgtgcatctttccttcccaactgtacygagattttgaattttttataatttgtactaatatgtaactagaccagatataatctgttgaggctttcttgtgatggaaagcaggtgaaatcaattttcagttgaaatatgcttttcagttcactatatgatgtttgtagggcttttttagagaagggctttgcatttagacttgagcagtttagcaggcttcgtcggagggtaaatctggctgctggatctagttggaatgttttcytttcataagaagagttggagataaagtgattcttgctttcaaatacacttttaacaatacaaaagaataattgaagactttttcttttgagacagagtctcactctgttgcccaggatggaatgcagcggaacaatttcgactcattgtagcctcracctctcaggctcaggtgatcctcctacctcagcctcccaagtagctgggactacaggcgtgtgccaccacatctggctaatttttgtatgttttgtagagttggggttttgctatgttgcccaggctggtcttgaactcctgggctcaagctttcctccctccttggcatcccagagtgctgggattacaggtgtaagccacygatcccagcctaattgaagacttttgtatgttaggtgctaagtaatacaaaagtaaaagtgccactgtttctgtcctcaaggaatttacagtctggagaaggagacaaaatataaacaaacacactgataagtaaatgattacaaattgtgccaagtgccatgatagaaaagaattgatgtgcattatctctgtgctccctgttaggggcacctgacccatcaggaaggccattgatcatacccatcagtcttccaggtataccaaggacattggattgaatgtcacaggacctggattcaagccctgccatcgaatccagctgggtgtttctgggcttcagtttctgtatattcagtaatagtatcgaatattagtgggagtaatagcattgaatgccctccatgctcactggaacttcatccacaattacmatgtcttggtggctttctaagtttttttttaatttttaatttctaatttttgtaggtacacagtaggtgtctatatttatggggtatgtgagatattttgataaaggcatgcaatgcataataatcacatcatggaaaatggggtatccatctcctcaagcatttatcctttgtgttacaaacaattcaattatgttttttaagttattttaaaatgtacaaatacattattttggctatagtcacactgtcatgctattaaatgctaggtcttctaattattttttgtaccctttaaccatctctacctctccctgatcccccagtacccttcctatcctctggtaaccatccttccattctctatctccatgggtycagttgttttgatttttacattcagtaaatgagtaagaatacacaatgtttgtctttctgttcctggcttatttcacttaacatgatgaccacagttccatccatattgttgcaaataacaggatctcattgttttcatgaataaatagtactccattgtttatatgtaccacaatttctttgtccattcatgtgttgatggatacttaggttgcttccaaatattggctattgtgaacagtgctgcaacaaacatggatgtgcaggtatctctttgacatgctgatttcctttcttttgggaatatacccagcagtgggattgctggatcatatggtagctctgtatttagttttttggggaaatcccaaactgctcttcattgtggttgtactcatttacattcctagtggctttctagaacctcctcttggggagccatatggaaattttgctgaaggtgagaatatggcagcttgatgcaatgcagtgttttttcaagcttcttaatttgttgttgttttgagacctaagtctcaggagagatgcaccgaggctgctgcagagctgtagagaggagatgaggagcgagcaaaggaggtagggttggaggcgcagggcatctcccaccctgacttgtctcagacatgcccctcctttatctgttgattataccaggcttacagggaggattttatccaaagaattcacctgctaaaagaggaaaacattttaaaattactgttgtagtccaaatagtctctggaactagacgattctggattccaaatatagacatgtggtgcttaacgacagggatactttgataaatgcattattagactattttgtacttgtgtgaacatcacagagtgcacttacatgaaccctgatggcaaaacatactacagacatactacatactaggcttatgtggtctagcctcttactcctaggctacaaatctgtacggcatgttactgtacttaatactgtaggcaattgttaatacagtggtatttgtttatctaaactatcaaaacctagaaaaggcacagtaaaatatggtataaaagattttatttaaagtacacctatataaggcacttcccatgaatggagcttgcaggactgcgtgttgctctgggtgggtcagtgagtgagtggtgagagagtgtgaaggcctaagacattactgtacactactgtagactttataaacactatatttaggctacctatatttatagaaaaatcttctttcttcaataataaattaatgttagcttactgtaactttctgacttaataaatgttttaatttttcaaaactttttgactctttttcaataatagcttgaaatacaaacacattgtacagctgtataaaaataatttctttttatcctcattctayaaacttttttgaatttttaaattttttaatataatttttaaaattttgttaaaaacaaagacacaaacacacacattagcctaggcccacacagggtcaggattgtcagtatcactgtcttccacctccacatcttgtcctactggaaggtcttcagggtaaataacaagcacgaagctgtcatctcctataacaatgccttcttctggaattcctcctgaaggacctgcctgaggctgtttcacagttaactttttttttttttaataaaaaatacatgtagaagcagtacactctaaaataacaataaaagtgcagtatagtaaatacataagcgaataacagtttttctaatcattatcaggtaatatgtactccatataattgcatgtgctagactcatacaagtggtagtgcagtaggtatgtttacgctagcatcaccgcagacacatgagtaatactgtgacattatgagggctatgatgtcactaagtgatagaaattttttagctctgttataaccttataggtccacatcatataggcaatccatcagtgaccaaaatgtcattatgtagagcatgactgtattagttcgttttcacgctgctgataaagatatacctgacactgggcaatttacaaaagaaagaggcttaatggactcacagttccgcatggctagagaggcctcacaatcatggcagaaggtggaaggcacctctcacatggcagcagacaagagaagagaacttgtgcagggaaactcccctttatgaaaccatcagatctcgtgagacttactcactatcacaagaatagcatggcaaagacccgccaccatgattcaattacctcccaccaggtgtctcccacaacacatgggaattgtgggagctacaattcaagatgagatttgggtggggacacagctaaaccatatcagtgactacagtactatagcagttgaatagttttttttaaatcccttgagtatcttatgatctataaaatggcagtcaagcctatcctgtggatatttgcaaggcttataaatattgtctggaagagaaagatgacttaggagtatattataactcttgatgtttttattatatttgtcattaatgtgcacaaattataaatgtattatcattaataataatttatttaaaaaagtgatgggatatcataaaacccttgggtgaattcaaacatggccactttgtatgacaaattacatgcttctatttctgttccacccagggtttcttttgagcagtggaaattcatctggaaacttaatgttatcccactatagagagccattcttgatgtgccactaattctgccaaataggctgacttgactactctcttaggatacagaattatatgaagmaaaatagagttgagaaggaaaaagtacaaacgttgtgtgtgcatataacaaacagatgactgctttagacatatttggtctgtaaacacctgtggaatcttgcctgtgtctctaatttttccagattttgctcatgggagagacacaatttgttctttgaatgtagccattatattttaacatacatgctgatttaatcatgctggtcaaaattttctttttatagcatccagacagcttgtgcatataactacatgcagttttattttgtggccaactggcaaccatatggaagtcagttaaaatgtattttgattatatgactctgtgcacataggcacatcatctcaggaaggctcaggtagcatagaggcaagtgaattcagcctgagattacagtaaagacatgaatctgatagtctggcatttctggactcacactgatttcttgaagaaaagcccatacagttggaatcagtgccttaaattaggtttcttaatatgatgagctcataaaatatgtgttgtccygccttcttcagatgtgagagttgatgttacagagatctctttggtaatatgactattttaataaaatattcacaattaaaaatrtatagaagaaagcagcaaggaaagactagaactaatgattagagttgttgaaaatgcatacataatttactccctttttaaaaaaaatggaactgggctattctgttgtacatagacttttgtcaaaatcaaattaagaatactttactcagttttctttttcttcctttattcatctctgtaaatatgattttaaaggcccttgaaaacaaaataattatcttattaaaatttagttacatgttgtgtttaaaatgctaaagttttggccagcygcagtggctcacgcctgtaatcccagtactttgcccgagatgggcagatcatgaggtcaggagttcaagaccagcctgaccaacatggtgaaaccctgtytytactaaaaatmcmacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctraaatttatcggagaaaacaattgggatctatttttagtctcaaatgtaggcatatacaaaaataatacatagtagttttctaagtactattagacatttgtttcccattttgccatttgctttcagtttacctgacatgaagataaaaatgatagctatttctcacttggcatttgaaagacaagagcaataagaaacccagcaaaactcctagagaattttcatggggaaaataagcatattgacattctttgacttttgtaaattgattttttggctccagctgctctaaagccattaagagttagagttaatcattcttgatttttttattgttagtcagttcccttattcataacactgaataatagcaatactactgagttttatttgtgttcacatttagtgctatgttaaaaaattcacaaagtaacatactgaaattcttgcaggtaactggtaaaatatgtagtctttagtagactgttgattgatattctagtaaaagagtaaatcttgtgaatttcagaggtggtcccaagatggtcttaaccctactgtgttaaaaaatatcagcatctttttcctataaagacaacctgaaggctcttttgaaatatgtataagtgcttctttttaaaaaacttattgatcaaatcagcttaattagctatgaaaggaatgatccttcacccctatgttaatgtctgtttacactgtgagtttgtaaaagcttctgatagagattgatgccatatctaataaattatcccactatatattcataaagtactatgattatatctatatgaatatatatataggtgaatgtagattcatatcaaaaattgaaacccagagaaaaaacttggaatttggtaggcagaaccatgaccctcctcaaagaagtcctcaccctcatccccgaaacctgtcagtatgctctgtaacatgattaagggcaattaacattgcaggtagaattaaagttactattttagtccatttgtgctgctataacaaaatgcctgagactgggtatgtataaagaacagaaatttgttttctgttctggagcctaggaagtccaagatcaaagtgccagcaggttccatcatctggtgagtactgcatcttcagrggggaggggaaaggaacagtatgttctcacctggcagaagaacaaaagagcaagctaccaaacactgccaagcctcttttatagaggccttaatcgcattcgtgagggagcagccctcatggcctaattacctcttaaaggctctatctcttaaaactactaggttggcaacacctgaatttaagagggggcataatcaaaccatattattactaatcagttgaccttaaaatagataatcctggatgatctcggtgggccccttgtaattacaagtttccttaaaagtggaagagggtgacacaagagaagtgagagtgacgtaatgcgaacaggactcaacacaccattgctgactttgaagaaggaggcctgaatttcaatagccacggaaggggacaacctttagaagctggaaatggcaaataatactacccaaaagccctcagaaaggagttcaaccctgacagtacctttattttagctctgtgcaacctgtttcagactgctgcagaaccgtaagataataaattcatgttgttttaaggcactacatttgtaataatttgtcaaggcagcaataaaaaaccaatgcagcaaaagacaataacgtctgtttaaccacacagtcacggaacatctattaactagcaacttattaaatacagcttactgctgcaacatctttggtgtaattaaaacatcctccatgaatcagagtgagaattatacttaagtgtctgccaattgccatgataakagaaaagcttatgatctctctactaagtaccttaggaagacaagggcccaatgatatgagcagtgtggtggaaccccaaacatcttcccactttcatgcacacatatcattcattctcctttttcccaaggttcgctgttagtatagaggcacaatagatcatgattagctctgggcatgttcacagtttagctgcctgagcagattaatttgagagtccaggaaaagcttattaaacagattatgagaactagacaagacttttgagaccatctgtccaaaactttggttttaccagtaagcaaattcagacccagcatcactcagctggtaggtggtaaaactgagaagagaatccatgtattttgttttttcctagttctgtgttgttgcactgcataatgaattccagccagaaccacacattcagttcctgactagtccacaattagaatcaccatcaagtcaaacacaagtgaggcattacatccaggaggtcatagttagttgtgtgtgtgttccctagatagattccctgaagctttctcatcaacaccaagaagctgaaggggaaaatgaaagttccccttcagttcccctcaattcaagagtaattgagaccaacatcattcatggatattaataatatgaccttttttaaagaatcaccaaatcattacatcataaagaacaatgatcttatattttactaggtttattagttgcagtctcagcctctaggttgctagaaagctctgggctcctttggatatggacatggccaaatctctttaactttctagttatggcactttaggcaaattcaacttctctgagtctaggttttctcctctgttcaatggaactgacaattctatgtcagagagctattgtaaggattaaaggaactaatatttgcaaaccccatactgttgcttggaataaaacaggtgctgaataaatggtagctatttgattgttagttttaaaaaatcttgctagaaatcattaagagtgtatttatctaagtgggggaaaagaaaaacctaagtaagacccttggatcttgaaagaaagaaaaagagagaaatgattgtcaacacaaacagaaatgcttgaggaacttcaagggctcaagagtcaaaggacaggctagaaaaaaatgtcagagaagaaagagctaagagaagaaagtcaaaggaaaggagagaaggggagaatggaaggagaactgagaaaccagcagtgtttttttaaaggtgataactgaagaaggtgagcagaggaagaaagaacacagtgagtaattgaaatcaccagttattttcttctgattcatctcttaaaggaaataccttctaagagagatctttgctcttttgtgtgctggtgaatgtaaggtgagaatctctcctttctttttctaatgatgaccctgaacaaggccgtgctcttcttttaaacatctcttctgtttgaagctctgttacaatagaatcaaatagggtctccttggtttatgtcactgatctaaggttgaatgatgtacttgacagatccttttgaactgccccatctgggaactgaaccaaagactggatcgccagtcatggtactcacaattacctttccctttccgcacagtccccacattcactacccgaaagtataaaatccatctcataagatgcagatgaagtagaatgatgcggtttcccaaacttgcctgattatacaaaagcccagaagcattgctgtctggagattcggattcttacctcaaggtgattcttatcattagaaagtgaaaggtacagaaatgaagaaactttcgagtaagcaacgtttcctaccaagggactgggtggttctgaatataacaccatctttctcctaacaatagaaggtgacattttgacaaataagcttaggattcgtattcttccctaaggtatcattttgctgagctatcattttttttctttctttttatttttgagacagagtctcactctgtcacccaggctggagtgccgcggtgtgctcttggctcactgcaacctctgcctcccgggttcaagcaattttcgttcctcagcttccagagttgctgggattacaggggcccgccagagtttctggctaatttttgtatttttagtagagacggggtttcactatgttggccaggctggtctcaaactcctgacctcaagtgatgagcttaccttggcctcccaaagtgctgggattacaggcatgagccactgctcccggacttgctgtaagctatctttttgccactcatgatgatgattgtatggatgactctctggtctgtgttgtcagtattcaagtggtacctccactctgtcacatcttcattttgcttgtctagcagacttgctagtcccttctgtcttgttccatgtcaggcttggacatatgaattgcaatcacattgtgagacaattaattgtccaatatttctcaagactccctgtcctttagaaactattttgcattcatctttgagtcctcagtattttgcctagtaaacagggtttgtcaagtgaatatccaatatagactcaggaagatccacatggggagtgagaaaattgagcgaatcccaggaaaagaacaggaaatggaggtaaaagactcacgtaagtttacccttctatccaggcatgcctccagacaccagcttccacttccttatctgtctggaattggtgttgaattgatcttcgaggtcagtttgaggtttcttactctctatatgagtctctgatacttagaatgttattttgtgctcagattgccagaaatcatgaagaaatgaaaggggaaaaatggtggcaataatgatgactaacaatgttttattgtgtgacatgaagttaaacagtaataatttattgttatattgaatgctgcagcattaaactgctgcctccagtgttaaaagcaatgctcacaagacagatcttatgagaaactctatgtaacagcaaaggatcactgaaatattcagatacagaatttacaatagttgcattagggcttcctttgaattaattaatatttcctctgagatgactcctgccaagtggttttgcttcattcctgatttaattgctaggaaaatcagaattattccagaaagtgaggctatgaaggtttcattgtaggaaaatcttgtgtctgaagccgtgaggctggacaaagggaaatgagttgaatgctgttgtgaatgggcagaagtcagcaccagcaacttccattcatttcgaagtaagagttgataagagaattgactgttgaagtcaaatctccgtatattttcttatttccttctttgcatccatcttgcaaagcaaatttttaagagaaaacgagtgtttcattcttgatagtgaattgctctgcttcttcagcaggaggtgcaggagaaatcctatttgcatcctttccactgctcttaacaagcccctaaaggctgagttaatgtttatttgtggcctggagtggccaaaagggaatagcaggaattattttcttcatagaagtggtggagaatatgagtgcctccctctataaactggagaagatttacctgcacaattctcctctctgctttttagtactgcttgggggatgaaagggacccatggactttggcctcagacacaccaggctggtttcaaattttccttttttctgaaatccacagtaagccacttaaactctctaagccacagtattctgttctgtacaattggaataacaatgctgtgtactggaacagcttcataatttgtaggcccagtactaaatgaaaattgggacccttttgttcaaagaacatgaacttcaagacagtaatggcagagcatcaaataggtgtgtggcccttctgagcatgggggctgtaccactgggcaggccacataccacgaagttgacctcactgtgcagctggattggctgttggatgtcagatatctttccctttgtatctctgtatctcagagagtggatccctgaaaatggcatttgcactggctgctagctagatttagccatggaaggcagtagtaggagactgatggtgagaggcacggggaagccaagttatttccctcttttctcctttcccctgtctctatttccctttgaaacgtatctccaatagtaactgctctcctctttcagttccagcatacctaggacagcccaccttctggggtcccacctttcctgatcccactcactgctagtcagttctctgcaggcagcccagctcctcatgctctaaaaccaccatttccttggttcctccagcctgacaggtgctagctgcttcctgatataactaatatcttgactacctccctgttccctatgaggcatttcagctcttccaagcctctttaactagttccccttattaactattctttattcttcatagaatctgatataagtgtctaccttgaaaggttattacaaggaacaaatttgtctaaggcagtggttttaactgtacattgcaattcatttgtgagtaatacaatcagtttgatgggtcaagaccggtagtttagaacacaaaataacttagagcagaataagaaaacatggtagtgcattgtatgtattaaggtacatatgatttaataaagcttttagttgtctctgtgtgtatgtgtgatgtgtaccatttcatgctgtaaaaatgtattactttctagcaggtgggagaaggaaagaaaggccaatggtctaagacttctggtacataattagcactcaataaattgtagaaactattgttgccatccaagaccatgccatttaaacaaaaggcagtcagacagcccaaagagtttaccattccaactcactttagctcattagaatagtttcatgtagttgggccaacttgtactaaaatggccaaagcgtttacttacatttgtttgtttacacctagacaggcccagcttgagtcaccagccttggctgaaagagaagccagccaggttcaaagtaaagaaacagttttaaaataacattttatttttctgtgagtcatagcaaatctgtccctgcaacatctttctcctgcagctaaatgctttaaaatggtcaggtctcacccaggaaagtgggactgggaggaagtgatgcgataaaacagcttcccaatcagtgcattagtaggagtgcaacctctggcattcctcttttttcagaagtatcaaaaagctctgcagagataactgtgtctccagatggccatgagattggtaaatgacaaatgtttatcagcctttcagcacctgctgatggaagaactaaaaaaaaaatcgcaagtgactttatgagcccacagccaccccagctgtaatgggtgctagtagctctgtgttgctgacctcacatgggtaaaggaagagcagaagaatttttagtcccttggctacttcttatctatttcatcaggtaaggaaactcaacttgaatcctttcaactctgaagaatggtagatctgaggaacaacaaagagctataggtcatgtggatttctctgctcagtcagagagcccagaactctccctggagctgaagatagcccttgcaagctatctcatgatggttttatagcacagtgggctcactcatactggtgctggttttgagcatctatgttgacaagacaaatgtctgtttctactactgcagaggatagagtttaaccaaagtcaggtgacagagaaaaagaacagaaactgataacacttacacagtatccttatatagcaggctcttgaataatgcaggcattggggtgacaaccacccttacagtcaaaaatctgtttataacttttttttttttcagatggagtcttgctctgttgcccaggctggagtgcagtggcatgatcttcgctcactgcaacctttgcctcccgggttaaagagattctcctgcctcagcctcccaagtagctggaattacaggcatataccaccatgcctggctaaattttgtatttttagcagagatggagtttcatcacgttggccaggctgatctcaaactcctgacttcaggtgatccacccgcctcagcctccccagctgtgtagataacttttgacgccccacagccttaactattaatagcctatcattgactagaaatcttactgataacagtcttttaatgcatatgttatatatatacattacactatattattacaataaagttggaaaataaaatgttattaagaaaatcacaaaaaaagagaaaatatatttactattcattaagaagtggaaattgatcatcataaagtcttcctcgttgtcattgtcttcaggttgagtagctgaggaggaggaggaagggaatgggttagtcttgctgtctcaaggatggcaaaggcagaaggaaatccgcatgtaagtggacccacgcagttcaaacctgtgttgttcaagggtactttatgttgtccgggatgctatattgagtactttatacatataaatttacttaatcctcacaacatgcctacaaggtggatactactattgtcctcatttccagctgagaaaacagatagagaaggcaaataatgtgctcaaatctgcacagttaattaatcatagagcccaaattcaaacaaaatagtgtggctgccaagtcaatgctcttgacctctacccagactgggagccagagggtttgcattctaattttatcattaaccaatctgactgatggggcaaatcaaccctactgcaatctcctcttttcatctgtaatataaggttattgcttgagatattttcaagtcttagtgccacctcccatttagagctttagtgttgagaaagatgatattaatgtattccgttgtcctaaatatttcaaacacgtcagtttctacttttccagacaactccaatggggatatttttttattcctccacttcctaattaaggctgaaagggccccatattcagctgctgagtctctgtctcccgccttcttttcctcctgtacgacctaaaactgtcttttgtctttcagcacttggggagaaactctgggaagctttctaaatccctaaatttgtcacacccatccttaaagcagtgctgaattaaaaagtgggattcgtctaagcagaggagatacttaaggaaggagaggggctacagcactaaatgatgtttccaattaagagaagtgtaaggtcagagagaaactccctcctggatggagctcttcaccacctgatgagctgattaaatatcatgccgcaaaaagtaaatgtttactccaagccaggtgcttggactctaaagaactctattaggcaagagtaagtggtttaattggctcaccttcattcaactgttagtatgttcctcataagtgcctgtcagagagaatcttttgtgtttcccttctaacagctggctcataaaaacataaactcatcttacaatgttaartaaggatcttttaattcctgttttctttcctccaatttgtattaatatgataggagagaaagaaagtgaaagcatgcttctatagctggctacttcatcaaacttaatggaaccatattttgtaattcattctataatttaagttttggtcattttatctcttaaagatgaattccaggccaggtgcagtggtttgtgcctgtaatctcaacccttgagaagccgaggtaggatgattgttagagcccaggagtttgaaaccaaccaatatagagaccctgtctctacaaaaaaaaaaaaaaaaaaaaaaaagtcaggtgtgatggtatatgcctgtagtcctagctactcaggaggctgaagtgggaggattgcttgagcccaggaggtccaggttgcagagagccatgatgatgccattgcactccagcctaggcaacagagcgagacactgtctcaaaagacacacaaacaaaaaaatatgaaaccctagctaaacactgtggactcaaaatamcctgtgaaatcacccaaccgtagtatttatctatgagaatgtttcaaagggagatatgtagttgtatgactatttcacgcagatatttgttattaataaaagactttgtggtcagcatgacgtgttagctacagttgaatccatgcttctttacattttgtggtttggttgttgtcgaatttactttccatgcattatttccaaatatatacttattatttcatcagcttagaatggtttggatagaaaaatatatcaaggtctcagaaatgccccccattaacataagggtagccatgacttgaacccaccccactggtttcctttgtctttctccatttctgattctctttctctgtggttacctaggatatataaattacttgactttgaaattcatgattaactcagaaagttatagctagtgattcacaatatttgttttaaaaacagtatgaagaatgtagaagcttggtttttaattataataatataaattagtatcattttatgtactcaaatgccacacacatatgtataaggcattcctatggaataatcttaacctggttctttgacaatttttgtaattcattctctagtgaaatatttccccaaagtgtatccacagattactatctcaccaatatgcttccggaaaaaaagtgccatggtctaataagtttaggaaaccttgcacattctttttccttgggatcaatcattagtattagcagatttagcactaagaaatcctgtagtagagaaattcatttacttttaattcagtatttctcaaaatcattttaccctattactcaaatccctgcttttattctgggaattgttacctctcctttcctttgcatacacttgagaaattgactctagaaatactagccttatgaaatattgatagtaattgctatggtttgttagactcctccaaatctcttgttgaactttgatccctagcattggaggtgggcttaatgggaggtgtttgggtcatgagggcagatccttcatgaatacattaatgccctccctggggtgggtaggaactgagtgacttgttgctctattagtttctgtgagagttgtcccccgactcgccgcagagctggttgttaaaaagagcctggttcctcttccccctctctctcttgcttcctctctctccatgtgatctctgcacacaccagctccccttcaccttctaccatgagtgcaaacagcctgaggccctcacagatgcagatgccagatcattgcttcttacacattgtgtagaaccatgagccaaataaacgtcttttctttataagtaactgagcctcaggtattcttttatagcaatacaaatggacgaagacagtactgattatttgttgggcatttcctatgtgcgaggaactgttacaggtattttggcagttgtaatagcgaggtatttattttggtgctttaacagagactaaaatggctgctttaaataagattgattatttctctctcacatgaaagcctaaaatggtgagcagtgtagcaacttagggcagcaatctttgggtcatccaaggcatcagataccttctgtggtgttgtttcaccgtcctttgaagtgttcctttcttcataggttgaaaccagctccttgtacctcatctggtcccatccctaagaaaagagaccaaagagccatccttgagaaaagagaccaaagagacatccctgagaaaagagaaaataaagggcaaacagcttcttgttaagaatctggtctggattatgctcatagctcattgtccaactgaataaattgctcaatttattgagctcataaattgctcaatatgacatggccatacccagcttacaaggaagtccaagaaatagtctcttattggggaacatttgctctcctgaaacatagaaggttctattatttaataggtagaaggaaagaatgagtattacaaggcaattagctttctctgctgtgtttttacctcattaaatcctacctacaacccatgaaatcagtactttgtcttcattttaatatgagaaaactaagatacagagaaagtaaaactaaagtcacgtagcgactattcgcttttggttttgataccatgctacctaattccatagcctgggttcttagctgatacacacagttgcaatgcctttccagaaaatttctagtagtttccaccattcctggacctattcttttctaactttaaaggcaatccatcttctaagtcagtgtggcagagactctagtttcttcacccaaaccatgttctcctgtctttcttgggctcatgtttaaactatatttctcatcttctcttaggtattaccatatgactaaggtctagtaaatgcaatgtgagaagatctgttgtataccacctccaggcttggcctgtaaaaacttcccatggacatgagctcctccatgccctttcccctccagctagatgaattggaaatgacacccaggacaactggaaggccatatgtcaaaatggacaaggcttgctcaccctgaattctagaataattttgtggaggagaactaccctaacaatctgttttcccacctagcaaaaaaaaatgtgaccacaaaaataaacttctgctgtgtttgatccatttgaaagtttttgatctattagttctagcagttagcttcctctaaaaaatacaattgattaccatgatgtcatggataacaagttggcaacctgggtcaaagtcctattcttgtttttttctagtgataagaccttgggcaatttattaaatctctccaagtctcagttttctcagctttaaaataatcttcaatcatagtgttgttctaagaagtaaattagtttatcttaaaaatcctattccctgttaattattccattctagcaatcaatttgtgcttattctagttgtcccactgtttaaaacacacatgccttagtattatgaaaacatttcaaaagaaatatgtcttagatttctacatttatattagaaaactttcaaatttatacttcatgccttttaaaaaaataatactagtaaaatgaaagaatatcagttttggaatcattccacagtcctggataaaaatacctgttagaccacttactagtggtatcatctatgtgagactcaaattcagcatcagtaattttggaagaatggtagtcctactttcagaattgttaggattaaataaagtgctaaaagtctgtgaaatctccttgcacactgatgatttcccttctctccccaaatagatttccatatggagcacttttagtcatttttgctggactgcaatcacctttctttcttcaaatgttaaaactgaacagtagtagctagcaatttggaatctctagaaagaagttttttttattattatagtgctgaagctcagctcattctctcaaggagcctatggatttggagtgcatcataagggaagaagttaacctcctgctgtattaccagagaccaaggacaaatgttggttgtcacctgcctaaccaggcaagtgatagtcacagactgtccatctcacaacaaaacaatgctaattttgttgagggatagaaatgttgtagttgatctcattttctctagcacagtgtccctttttgaatgttccttctcaaatagggcatggtataaactctgcaagaggggagttccatttggaagacatgtaggcaaacaacattcaggctccacacccacttcgcctgctgagatttgacttattacacaactgcagatgctggtcaattagtttctcatactcattcgtatcacagaagggatgcagtggttataaattgcactgattatgcacaccttggcttaccctattgttgcataaaaataggcaaggcatgttagtcattgcatagtcttttcagtagaaaggaaaagtgattgagaaacagcaaggaaaattgtgtttacagctaaggtttttgttttgttttgttttgtttccactccgttcagtgtgtatataaagttaatgcatttttaacttaacagcaaccaacaacagcttcactttgagtgcatgaaaaacactggggcttaagtgttgatttgttgccaggcatttcctttgggaatccatgtaggctgatcatttacctgggaaatcgtgtgtgtgtgtgtgtgtgtgtgtgttacctttacctttgtaagggacatcataaaacctcaatttcctggtgtgttccagttaattttctgctttattgaatgtcactctgaattccctatttcctttaacttttgtgttgaaaaatcattcaaaagactactgagccattttcttcttcattaagaaaaatattgggttagacttaattcttgatagctgaaaattttggagcattgttttgtttgtttgttttacatttttgaaacaaactattttgagaccgtaataagaacaatggataatcttcccagaaatcagagagagaaagagagagaattctgcataaatttatagatccttgcagcccacatttgaggccccagcaatagaccccaggttaagaattcctgccatagagtgttttgacattatcattctaaatatttaattttgtccaaataaaaatatagacagagaaaagggaacttagcaaaaatcttcatttacattcaaaacaattcaaggtgcattaaaatcatgaaaaactttgttcctctataggccagggaagtttcttgctacttatttcctttattaaagtatattttattgatttgtctttttcttttaaaaacagaatatccaatgggtaagactgaccaaagatttggggaagttgattctaaataggtgagctgtgttttaagagttcttcttagtactcttcaactcagcatgtggaaataaatttcaaaagcttttcttaatttcacaaaaacaaatataaatagttatggggggaaataaacaacaggccaaataccagatggcaactcaaagcacattgtctgctctcttgctctaagctactggttctcagtaggggtgggacagctcccaaaagggggtctttgggaatttgtggtgggtttttggtagtcacaatgttaagaggtactataatagctatttagatggcagagttaggatttcctgtttctttttctttttggtatccctcatgactatatagtctccccaatatattcacatgggtgaaaatcctattcgtaatgattgaactcaattataactccatttacagataaacatgcacaaaattttcatggttttaatacactgaattttccaagggtgtgtgaaattgctgtacatattgacagaagattgttgtttgatttggttaagaactttttattattattattattattattatactttaagttttagggtacatgtgcacaatgtgcaggttacttacatatgtatacatgtgccatgctggtgtgctgcacccattaactcgtcatttagcattaggtatatctcccaatgctatccctccccgctccccccaccccacaacagtccccagagtgtgatgttccccttcctgtgtccatgtgttctcattgttcaattcccacctgtgagtgagaacacacggtgtttggttttttgtctttgcgatagtttactgagaatgatgatttccattttcatccatgtccctacaaaggacataaggaaatgtggcacatatacaccatggaatactatgcagccgtaaaaaatgaagaacttttttaagagttatttttcactttagaaaatcagctagagaccacaatgctgtttatggtattgaagtccccatgagaatgcacctggatcagtgtacatttgtaatgatcagattcacagtgattccatgtgtaggtataagcttttctctacttcaccatgtgtccttgtatagttattgataggggttggctgtggccccctcccaaatctcatcttgaactgtagctctcataattcccatttgtcatgggagggacccaatgggaagtaattgaatcatgggagcaggtctttcccctgctgttctcatgatagtaagtctcatgagatctgatgattttataaaggggagttcccctacacaagttctctcttgcctgccaccatgtaagatgtgactttgctcctcatttgccttctgccatgaatttgaggcctccccagccatgtagaactgtgagtcaattaaacctctttcctttataaattacccagtcttgggtatgtcttcattagcagcgtgagaacagactataacagttatcctgcatcttaacatatttcaatattatttattatatacttatatataataatataaaaatattcattgtgcatttatatatcataatatatatattatgtaatttttcattctgtcttataatttattctaaaaattatatttttaagttaatttataacttattaagtcagtgtttctttaggaaatgtgccctccgtcaaaattttattctttttggtctctttgctagtatgctactagctaaagaaaattcattcccactaattctggattcttatagttattcacagccatgctgttaaagagacaagtgaattactaccttctcagagttgaactcaagggggaagtttgactattggctggcaaaataaagtagtggaaatttatttcttttgttctcaataaaataacctgtgaaccatcctaaaactaaaaaaaggaaattatttatgaagagaagttgtatcatttaaattcgttttctctcttttccctttatttcagaaaccttccataataaaaacttggatataatgaaattttgcataaatgacatgtgacaacctaatttagtggaagccagggaacctgctaatactttaacttcaaagctcttccattttattccttcattacttttcctcctttcaaagcattctttagccatgcaccaagttcgaacaatgacgaatcaaatcctcagagccaagaacaatgttctaatatttccatgcaattaattgctacttcttggtgagcatccagtatacttgattctctcatagaagattctccaagcctgacactcggttgaagtctgaggacttcactgaggacaaagagggatcaaatcttcccaacaaacagtgaactcaccatgcaaagtgaatagaatcccctaatcaataaatcactaaatatttatggagccccgaaatcatattgtgacaagatttttcaaaaaaaaatgtagaaactaagttatgatacaatcacatgtcaggaaggtatattggagtactacttgtccaggactccactgacacccccttgtgctccctatgtcattttgatgtaccaggccattcactgtatctataacgtgaatttttgcccctattttcaatgtcccccatcctattagcttttcctttccagtaaacttctccaaacccttcctcagtgtttcaaaggcaacaaaagttatcacaacaaaagtaactagtatttcttgagtgttcacagtgggctggacaagcaaagtgctttacctgcattgcctcagttaattctcttaataacctatgacatcagctctattattaacctcattatacacatgggaaaatagacactactatgggctgaatatgccccctccaaaattatgttgaaactaaatccccattttgcagtattaagaggcagggcctttttgagtggccagccttcatgagtggattagggccttatgaaggggctggagaaaactaacttaggccctttttgcctttctatcttccaacatgtgaggacatagcatttgcaccttctaccatgtgagaacacagcaagaaggccctcaccagacaccaaatgtgctggtgccttgatctttgacttcttagtctcagaactgtgagaagtaaatgtatattatttgtagttacccagtctatggtattgtgttatagcaacatgaagccagacagaaaaatttacagttttcatcacttggcagaggtcacataacaggtcgatttgattctcaagccgtctttactattatgcttacttggcttttatctctgtagactttaattgctgagttatctttccctgagtcattgctgcttcaaatctcagtctttaggaatcacttctgtaatctgctgattaattatgcatagatcataaaagttatttaatccagctgctgtccagagtcaatatcactatcctactcaaaaatctgcaacaatctaccacgaaaaatcaattctaaactccttagtctgacattaaacagcctgataatctgatccaatccagcctctctgcttctacctatcttgtttacctgtttgttgattcttattcaattgcttccttgatggaggactttcccacccactccatcactacctcttgtttctgcctgcacacatcatttccccaagtcttttgataagaaagatctcctttttacaactatttctctgctctctcctctccaacatatcttcctgacatgtgattgtatcataacttagtttctacatttttttgaaaaaccttgtcacaatatgattttggggctccataaatattttgtgatttattgagtaggggattctattcagtttgcatgtggagttcactgtttgttgggaagatgtgatccctcttttctctatgcttccatcatgacctggatatacttctagtatggccctttctaattcttcacatgcatgccttcactggactgcagactccaagacaggggccatgcagtattcatctttgtgtctttccagttactccacaacaatttattgagtgaataaagaaaatgctgagaaacgaactcaagaggttttgtagatttaataccattgctctgggtatcgcaaaagataatggctattaatgaattagtaccccacttcccaccacctcaccctgttgacatagtatgatagaatgtgtaaccacttaatctaccttaagatgctattgggcaacaacaatgtcttgactttaggggctggaaagcaaatagtatataatgtccaattgctcttgtttggggcagagagcacagatttaagaaacaaggatacaataaaatgaaatttggctgcagtacaaggttaatgtctctcctcacctcccaaagagtaccaagggatcattcattgtcacagctgttggggtttagagctctcttctcatccaaatgccagtactttccacaaaaagctcttccccagggatgccctaataagccagtgtgtcctgtataggtgagacttgccctggctgtctctatccaagtggtgacataagctcatctaaagcctttcattaatgcaaacaatgacccagcccatggtggcactgattcttgaagctgaagacttggagaaggagcctgattttccatcacactgattgttgttttcagtaagatgtttagcttttcaattttctctctgccaaatacaaattagtgtatttccaacatcccagagtcttagctgtgcattgccagcttccactgcttctccttaattaacaaacagctgtagaagagcttctcaactgacatggggggaagagctctaaggaagatatggactatgtctcatatcttcaaatcctccacagtcatctcctgttagatcaccaagaagaaatgcccagtggagacacttcagttcaatgaaaagtttatgactagttgggtttggtctccattttgtattaatgtagttgggttcagtctccaatctgtatgtatgtagtttcctatcccagagagcaggacaagaccatataagctctatttatgtttcctttgactctttagctgaaagcctaggatgtaggacaagtggctaacctgttttagaactttcttcctasgctaacattctgaacttggccttgtggattttacctcttaaactgcaccaaaaaccatggaaacaaagggcttacagcagtgttagcctaatctgagccctctataccttcctatactgtggccacagcagtaaagctacgtggtcttgcaaaagaccttccaagagaaggttggctacagaccttgcttatcacaccatgaacctgaggaggaaagaaaatactcacaaatagtttagcccctttcataaattgttggtccttaatccatttttgaaccctactctgttgggtggaatgtgtgtgtatctgcacgtgtgtgtgtgtgtgtgtgtgtgtgtgtgtttagaaattcaaaaaaaatgaggagatcttggtcttccatagagggaagactgcattatcaatagagtctttcttagcagaggatgaaggctcctgtagctcctaatcttcccatttgtgcacaaatacstgaattctgattaggttgaaatcaggaagacactcttttgctgcttagtggccacatctagagctaacaacattatcagtgggatggtgattcatggtttaagaacataccctcgccattccagctactcgggaagctgaggtaaaaggatcgcttgagcccagagtttaaggctgtagtgtgccatggtaacacataactagccactgtactctagcctgagcaacatagttagaccccatttcttaaaaacaaaacaaaaacatccttctcctcttctcctcccccagcaattctggatggctcatctaataaagtacatatattttacctaatctagtcaaatgtaatgacacaataagattattattattctccaatccctgctctgcaacatatttggctgaacatttttggctgcaacatttttggctgaagagaatgaggtttcttcctccctgaacctgggaactaacatgaggtgttttcttccacttggtggagctgtgcacatgtgtgcttgcggagaaaaagaagagtcccagcaggccctctactccagctgttggagattgagctttccagtgcattatcctggctttatgcagtgatgccttccccctgatggcagtaaaattttaattagagggcaatgtgcattcctatataatggagtgcacacatggcaggaagttaacaggacacgtttgcagttccagtttcattgtcaaccagctgtgtgattcctggcaatttgctttattttgttgtgtcacagttcttgactaggtaaactggagagtcatctctggtctactttcctcttcagtttggtggaagtttcacgtaaaattacatgtgaaagtccttgagaattgaaacaatgggcaaatctatagcagaatgcttgttgaattctatcagctttcccaaggtgcaggctgcccatgtttagtctttctcactttccaatccattttccacactgcagccagcgtgttttttctcaatggaaatctgatcatatcaacctcttttttaaaaaaaatcctaaatatcttctccctctcacagaataaaaatcacaattccttaagaaactgtcaaagccttctcaatctgtgcctttcatctctgaccattggtatctttcttctgataggataaaagttcattgaatgttcaagccttctcttttgcttttcagagcttggccatgtggttttctctgtctgaaacaagcttcccccattcctttctaggctaactcctactcatcctccaaatttcagcacaaagtcacttacagtgggaatgcttccatggccctctattagcagcctctgatttatgctcccacaatagtcggttctgcctctggaccatgttttatcctattgtttttcctccataagagcacagtcataatctgtataactcagtgttgtaactctggcagctagcacaatctcaggttcataaaaagagctcaagaaatatttgttgaatgaccaattagatggcatattcatttcctagggctcctataactaacgctagcgtggtgccttagaacaacagaaatttatcctgtcgtacttctagagggtgggggtctgaaatcaaggtgttgtcagggctgtgcttcctctcagattctacacagaatcttcccttgcttctttggtggcgatcagtcctttgcatgctgtggcttgctgctacatcactctaatctctgcctttgttgtcatatagcattcctcctgcatgtctctctttgcacatggcattttcctcttataaggaaaccaatcacattggattagagcctatcctaatggcctcatcttaacttgattacatctgcaaagactctatttccaaataacgctacattcacagatactggaggttaggactttaacatatcttttggaggaggatacaggtcaataacagattgctaaaccaattaactaattactaattaatataaattatgggtggaaaaagcttccccagatcacgataaaaagctgtgtcgatctaatcaacgtgcttgcttaaataaggcatgtgtataatatatatgcatgcatctgtgtatatatacatatgtacacatgcattaattatgttgtgcaaaaaccccaaaggctatttatcccaaatagaaaatattgtgtcgtttgtctaaagcactttaaagacatctgcctttttcatatgtaaatttcttggatgacaagaaattactgctttgctagcttttaaaacactaaattatgataatccatcaccaaataaactataagcttctatcatttaaaaaatgtaagaactctgaggttagtagtagtttttagttgccattgaaagacggcagtttaacgtcatcgtttattcagatttccaaattaaggagatctctgtggttagacattcctttcgttatcactctccttttcttcaggcctgtcatttgtccattgatgtcttttccttccaaatgattcatgtacacattaggtcttttccctaagcctcatattatgaaaagcaaagctacatgaaaaaaagcaaatgattgctaaattatgtcctaatttctagcattcagcagtgctaaaatgaagcagagaatttcacaaaattctcagataaagtatatttttaccaactaacattgggtaaaagggactgagatagagatttatttttattattattaataactttgaaaatggtgcatttgggaaactacttactaatgttcattggaattggtggtaatactgaggtcaggatttaattccaggcattacccaaaaagtccatgtttgccttgtttcaagcctagagttcttaaaacaatccctgcaaggaaccaggcataaattatctttcagattggtgggcgtaggaatctatactgcgagctaactgtgctgaaatagacattttagaggatgtgaatgtctatctcagacaaaggagattacaggttattaaccaaggcacttttcaaatgccatccctttgggctttcttacttagagtttcagattcatttagccaaataccagccttatcccttccctaattttcctaaatatttgtggctgaatatacttttagctttaggagtgcagaagactttgagggaaagaaggcagggttgaaaaaggatgagtttcaggtcattacattgcttcaaggcagtttgcagcttgcattcatatttttaaagtctaaattagagccctttaacaccaactatcttgggcacacatgtatgtagaagcataccaccatatggcaaaaggcagagttgctaaaactataaataacaaagaggaaggttaattagcaaattaattagctgaattctatacaaggtactaacaataccttaatttccagatacatttgttatcaaaaatgtctaccttaataaagctgtggggacttactaagtgtatttgctgggcatggttcccagttatgaaatattaataccttgaaaaataaaacatgcttatgaaaatgcagttatgctctcattttcagaggaatatgtaagtgaggaataatatagaaatcctaaaacaactggaaattcagactaaaatgaagtagactgtagttttgtcattgcatgttctgctcatactaaagcacctatcctcccactttaccttctttaaactgcagggcagagagttatatttttcatcttcatgttgagtagagaatccatgaaaatctaatacccagttatcactcaagtgtgacaaatagaaaggagcttcagaataggatcttcagttctaccaaatgtctctgcctaattacatcaatatccatgttgatgagtgtacaaacctgtggctaattatattttcacttcttctaagggtaggtacactaatgtgtgatcccacagaaaagggcatgaaagtaaattaaaggtgtgtgccatgtatattaatgcctttgtggttattattgctattgtcttactcccatggatattggaggattgttgataagacacttaaatgttgataaggcacctaatgagtatcctgtgtgataggagtagtacacaatgataatcatttccttctttgtgcattagtattgacatagccactaatcaggaactgtaaactctaaacttgtatctgcagccctcttattaaaaagattcctggatttttttccctaagctagaaacagacagacaaacaaaaacaatgattaaagggcactaaaagatatatttaaaggcagaggtttttttcctatgtgtataagattcaaattaaattcctctttttggctatttggacagttttggcaattgggctgaagccactatgtttttgtcataacaggtcaaggattgcttactcatgtttgagaagcaataatgatatggcaagagagaggtaagggactacaatgggaggcttattaggaattgtgcatgcctctttcatgtgtgttgtctccaagctaaccttgtgaggtacgaattatgacttcttcctgaaggagaaaagcaagttttagattaagtgcctgacattctgatgtcataaaaagactgaaataagcaacattttagcacaacatttgaacagcccttttcttaaggataagctctttgctctacaccatactaatttccaaaaaggtgtgagattgacatatgaaacttgtacgtttatataaatgtgaatgcagcaagccagagaacagaatgttctgtagcccaggcaagaggcagaggaaatacccagtgacagatctacttggccctcgactaaaggggcgctgtaactttaaaatactaataaatatttagcttggctttttctttcctatttgctaagtcctgtcttgattctctggctaaggggtgtaagaaagtggctgtttgtgataaatagttgtgtttgtgtgtgaatgcatggaagaacacatctgagataatatagtgtttactgctttgccattagcacaatgggctgtctttacagaatatgatgtttaaatctatgcaccagtgcactttcaaatagagaattcgcttcctgttttcacttaaaactctctttttattttaattaacgaaaaagcagtttaatcatccatctttgcagctaaggaagttttacaggcttataatactgtcagattctgcggtatataaatgagaaatagacacttttggggaagaaattggccagtcttccttccttccttcctttcttcctttcttctttccttcccactcctcccccctttccccccactctctctctctttcttcctatgaagagactgttctaaaagctaggaagtttcattgatggtgtgtgatttcacaagctggattttatttcagaacacctgtcaaattcagagctgtctgaagcttctccaacatcattaccccagggctcccagttctatgcacatgtttttataatggcaggaaaaagaattcatatacgcatttgtgtgttagaatcagtggtgtgctggtgtaacaatcagctcctaragggtgaggcagggtgggtaggggatgtttagaaaaagtgggtatggagaagtccctgaattctagtttttgccaaattctgtgatgcaaatactcccaccacagccaatttcaaggttatttttcccagttacatttaatcagggccatacaagatgttacaagaaagaaaatgacaggaacccatgtggttcaactgatactcactcaggagctgagatagcatttcatttatgcaattcaaatagctattggtttggataccttagtattgtttcttccaagaaatattttcattctttcctaaagggataataatagacattcatgacctaatttaggagataatcattttttattttatcactcattattaatgcttcatacgaaaactagatttatgaaaaggcccatggattttacatctattatatcatctcctgttggtttgagaatgaaatgtttgttttgctaatatgtttttctgattaagaagtggaggcagcaggctattaaaagtttttctcaaggcagtaaattggtagactagatatcttcaaattaaaaagtagtgatttcttaggcctgttcatagattattcaaaaatgggttaaagcacaggttgaaaatacttttatgggccacaggataatttaagtgattatttttcagccacttttttttggaaaacatatattagctaatgtctgtaactttattaacttaaaaacaaaagtccagataaaagaattttacactctgccaagcagtggtgcccagcttataggtggttggttctgcatcttacattttgttacttgtaaggtctatgaagaaaggactcccttttctgccctgctcactgtcaaaatttcagtctctacagcatgaagactctacatatagaagacactaaaattttttttaaatatatgaatgaagcagttaatttaaggcagcaaagtcacgcctatacattatttctgtaatgtttaattttaagtataattgcttattaagtagataggatgcttagaaactatatttacctggaagtggcttaaaaatttccctatagacaaaaaatataatttgaagtagttcgtcttcaaaataaaggcctccagatggccagatacctttcatgtacatgcatcaattagactgtaccagaagataataaaaagaatcctattgttttaattatctcttttattctccaaggaacccctattcctgccaattcttacagacgttattaaggcattcagttagtttttcattcatttatttaaaaaatatttatcatgccaagtactatttaaatggtggagataccaaagtgaatgagatacatacaaggggccctagttctcaaggagctcacattcatgagaaattaagttcacacatgcaagatataccagatattaataagtattactcagatcattaaactagaatgaggccaggcacagtggctcatggctgtaatcctagtgccttttagaggctaaggtgggaggatagcttgagcccaggagttccaggatacagtgagctatgatcactccactgcactccagcctgggtgatagagtgagaccctgtctctaaagaaacaaacaaacaaaaagtagaaagatttgacctgagaataactagatagctattttagatcaggtattcatgaataaaataacacttaaagtgagatctgaatgacagaaagaaaagccatgcaaaaatcaaggagtagggtgtgcagatttcacagatggcaaatacctaacatggtgatgctaaagtcagcatgaacctccttctgtttcttgaacagaccacaggctggagaagaaaaggtaggaagaaggctggtataagatgagggtgaagagagaaccaaggccagatcatgggagctttatagccaggctaaggtgtttatgtttaattctaaatatagcagaatacattggagaagactatgctgaggaataatgtgacttgacttaaatttttaaaagactacctaactgtgtatggaaaatgaattgcatgggacaaggatggaaactagttgggagatgagttagaagattattataggagtccttgtgggaagtgttggtgactgttggagggtagtggtggtagtgaagatgcataggagtttctgagcttgttttggaggtagaggaggcaagatttgttaaagaactggcttagcagggtgggcacaaaggaaatacagaattaaaggataattccaaaggttccaacctgagcaactaagtagaggctggcatttactaagatgggtgagattgagagaaggggagtatcaggaggcaagattacttgttattttttagccatgtttacatttttttgagatatcttctgagtatctgagaagaaatttcaagtgggcaatttgttggacaagtttttggttcatgggagaaattaggacatggatgcaattttgtgagcctgtaacacacagctagtatttagagctaagggtctatatgaaatcacctaaatagtacttatagatatgaaagagaaggacagagcccaggggtactcttacatttacaggtgagcataaaaaagaaatcaaaagaaactctaaaggatcaaaagcaaagtagaagaaaaccaaacagccatgcgggagtgattgttgagatgttttgaaaaagagaaggttgacagtcatttaggaaggtgaggaatcaaacacagtgcagatgagggtggtgtagggagatcattctctaggtgccctttgcatttttgctcatcttacgatcagagtcactaactctcttggttcaggagttggaagatacagtggcctgttccagagcaaaggcaggttcagttgctgttcaggataatgaagataatgcctcccactgaggcaaagatcaacagagcttactgcccattataaaatattcagattccttaagcgcatggttcctctcctataatacaaacctcttgcaggtactgttgtcacctggcccttttcatatcaccctgtgaggagtggggcccagagaacctacacaaatgcaaacacttcaaccactgctattgtcataaagtccgtggtctctgacccaaagtctcatgtcccctgctagcatccatgaaacagtggcaggtgaactttgaaaacaggataggctaaaatctcagatccttcactactcttcacagatagtaggccattgtgatggtctacttgagctctgttgttgtggtggcatatctttctgtaccgatattcagttggtttgatgcaagcatggtacaggtagatgggtttatgccttagatatttaataagaatgccttaacacatgatcatatgtcttctttcttcactgacaatggcaccccactaatggagtgtgcaaatccaggaagaccagtgtttgaacgttgtggggtaaagtgccgataggtaagcccgcatatttagatatttctaagaggttctaaaatgatgaatactttcctcaatcatttgtcacaaccaaagtctatattcttatgcttagatgtcataattcatattaaagaattgggccttatataacaccttaatattaatagtacttggctaagcacagacgatcaacaacacttaattaatgaaactagttctgaatacattatatactttcagggtatataaggaggtaattacattttacagaggcatatactctatatctggtttattcgattgtgaatcaataaacatgggggttttttttaaaacatgatttctatgatgaatttttaatttaattgtaggaagctcctttaccgctgagtcaccagtgtcttcttgtataatataaagacattatggcctggcatggtggctcatgcctgtagtcccagcactttgggaggccgaggcgggtggatcatttgaggtcacgagttcaagaccagcctggccaacatggcgaaaccctgtctctactaaaaatacaaaaattaggcctggtggtgcatgcctgtagtcctagctacttgggaggttgaggcaggagaattgcttgaacccgagaggccaaggttgcaatgagccgagattgcaccactgtactctagcctgggagacagagtgagaccccatctcaaaagaaaaaaaataaaataaaagacattagccatctggagcagttaagtatatatttttctataaagcaatttaatgtagatgatattttctctctgtgtgtgcacaattgcatgcatatgtcaagtgtcgtgagattccaagtatttgacgatctgcttcttctatagacagttgggtacataaaaggagagccatgtgcaaatccagtctctggttctaggtttatacctcctcttctccacctccgctttccttgataacccctgatgcacacagccagccatcctcatccctcgagatgtggttgatttctctctatttgggtttcaggaaattgtttttcctcccttctgagagtctatgcgctgctgcaggccagtcagtattgattcaattctgggtgaatcctctctcactctttcctaagtgtatattgtatatgtagttcttctgccaaaagcagctttgtattaagattgtattaagatttaagttttcttaaatttgcaagtcacctaaaatatatcctgtgtctgctgggatccttttgatgttgaagcgtcttggagtagacaatagaggattttcatatggtggaagaatgttaggtgtccttgttggagaagagaggaagagtagagaacccctttaaagccctcttactgcctgttccttgcatctcatctctacatatttagcaatcacatctgctgatttggcaaacactaacagcagctacacagcgtcagtgaggacaatagtgagtggatttaaacatcaggggcgatgtaccagtgcaataaatagaatatatcattgtttcactgcggacagaatgtctgtgctctctatgaggatctgcatttaagcccaacacccaaggaaggcaaacatctaaagctcagcatggggtccttcaagcaggggaatacaaacaaagcatttttctcccaaaacacaagttttaggatttcatgtcaaagacatgctgccaatcagaagacagcattcccccttcttagagctggaaatggtaaccaggacacattggtatgcacaattctgctggctcagagcacacgcaagctcctaggctgtgactggcaggaggctcacagcgatttctttttttttgagacagggtctcactctgtcgcccagactggagtgcgcagtggtgcagtcttggctcactgcaacctcagcttcccaggttcaagcaattattctgcctcagcctcccaagtagctgagtttataggcgcccaccaccaagcgcagctaactttcttgtattttttttagtagaaacagggtttcaccatattggccaggctgttttcaatgtttttgaactcctgacctcaagtgatccacccacctcggcctccctaggattataggcatgagccaccatgcccagcaagctcacagcaatttttaatgcaatatgatcagacctaattttggctttttgatttcctcccttaaacctcaggcaggcactttttcaaaagagaaatcaatcagtcaatcaatcagtcaatcaacagtgagtgaatgaatgactaaattgtttgtttttagcatggcataaaataatccttaatattttgacctcaagcaaccattctgaccatatcttcttccatgcgcctttgactgagtacccagatacatgcagagtcaagttttctagatcacagccttgtcctctaattcagtgccttggtatgaaatctttcttcttctatgtcctttttttgccagatgaaatttcagtctttattcaagatcaagtgcaactgtctctttgaggaaagtcctttgaccgccatttctccccttcagaaggcaaacacctgggggagaagatctgcttaaggacctggtaactgacaaagaatggaatgggagcgagaaccgcctagccatcccttctccttgcacagtcatgaaacaaaagttgaaaaggagcctggttttacttgaccagtcataaattaccataaaataaaatgagatattaggaacctttgatctctgaaaaagtaatatgtgttgaaaagaaatatcactgttacatatagacaaataatagaaatatttgaggcatgcatttaaaatgtagaggccacttatagcaggcatattaacatgtgcatttgctttttaagaagtatacacacgtgtacctttagctttgaaagggtaagattcaatgcttgggtgatggatgcactaaagtctcagaagccaccactaaaggacttacccacgtaaccgaaaacaacctgtactccaaaatcaatgaaataaaataaaaaggtaagattcataaatagcaagttgagaatgcatgtttataccatgtagacaatgcatgataaattgttggcaataagacccatgtagctgactttggggatacaaagtagcttctgaaagaggttcctaattagccctgcctgaggtgactgcttaaggtatttatctgtagctggaatgcattgcctcagagacttgaggattcaggagctatgagtttcaaggccacagatgcagtggaatagtaaggcttcttcccctgcctggcacattgacctaactgatgagaggtgccttagggacccagcagctatggccatttatgtctagtccctcactctagaaaggaattgcttgaataccacggtgctggagtttgtagccacaatgctgaaggtcagggcagtccttcatgatgatgcatttctgtcagccatacttgcacatctctttaatgtctgcaatgtcattaagcagtggtgtatcatttttttttaatgcagaaactaaactgatactcaaaacctatgacaatttgaatccttcctgcctatccaaccttagtttttctgctcgataatataaattctccctttcagtcaggtagatagtcttcctgtcttcctgtcattcttggtttctctttgttgctcttgtcttccccacctgctgaaatgcttttcttctttctttcttttttttttttctgagaaaagacctcactctgttgcccatcctggagtgcagtggcataatgacaactcaatgcagtctcaagctcctgggtcaagtgatcatccttcctcagcctactgagtagctgggactacaggcatgtgccaccacatctggctaatttcttcatttttttgtagagactgggtcttgctatgctgcccaagctggtcttgaactcctgggctcaagtgatcttcccacttcagcctccaaaagtgcagggattacagacatgagccacccatgtacctggtttctctcttcttttctaactaatcaagtactttaagtcacaactcagggtgacaacctccacctccattgacttctccagagcatttcatttcctcttatcctttctctgcactttgttagaacttacattctgatttgtactgttgacctttgagcccttaagtttatgcaccttctctctctctctctctcgctcactctctctctctctgtctctgtgtctctctctgtttctgtctctctctttttctctgtcaattattttattctggtatttggtacttatgagaaatcttattagtatcctaaactctctcaaaacaggaaatgtgtattttccttctcatctaattcttaggaaacttcatataggaataaaaaatatgtagtagtggattgtctggtaaatgaataaaagagggatttgaggtcagtgggctgtttcaggacatgaccaaggaatgtggtaccagggcagcaacaagcttgctaaggggcgataaagtagtcattgtatataacagaggaatttgggctcaatgcagatttgccactaactctttggcagtatagaattcactagagaaatattagtaggttagttagtattcctaataaagaactgctaataccttatagagacataagccatgtttctcgtctttcgtttctgaaatgaaattttggccagggaaacattttgcatccctttttgatgtctacaaatgtggcatttgtcagatgtgagatagttaagtgtgtgtgtgtgtgtgtgtgtgtgtatatatatactttatatatgtatatatacatatcctatgtgtgtgggtatatatatatatatatatatatatatatatatatatgaatgatgcatggagagatatctcttcccwtgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataactccgactaatagaactcattgcttttccagtttgaagataaaggatgtctgcttgctttccatgcctaattttcctgatgctgtaaagctgttcaggaaagttcccactgcaggagttttgctagtaatcttcagctccgtgggaagcctttggactctgttgctatccctgaaagtggctgttcttctccatcagtttcctgggcaagggctcgaaccagctattagtgtctatttgcactgcatgaaaacaaaatttaatgtaaagacgcttatagcttgcctaccctaaaaccccaggagtctcattctgcctgaccctggacattttttgaactgatagagggatgggtatctggtgggtctcttcagtcagctcatctcagcatgttgaaagtccaaatgacccttgcctgaggatggtgaaagtaatttgtatgtgtgtatacataatcctgctttttcactatttccagtcacagattgcagagatagttgactgtgcttgttagtgtgagtgttaataactttgctatgctgatttttagacttcctatgctatatgatctccctgaagagcatgacagagcattgctttggaaaatcaatattcggcgtgattattccttctttcatgtgtaatcaaactttgaagaccaccaataggccaaatctacaagcattaggtttctaaacatattgtttagtcaggagaaattgtgttttctagctgaggtatgccagctactggtatggagaaaatctgcctagcaaattggaaggggccagaagctcaaatgctattgagaaccactcaacaattcttttttcttatacacaggattgaagcacagagcaaaaggaaaatccagctttgggatttgttcccttgaacttacaaatgattcattagaccaatgacattgtgagaatttggtctctgacaaagaaataaatgttttaaaaatagtgctaatacataggtacaaatacagaattatgtcaggcatgtatttttttaaagatagagtccagtgaaaagaatacgtgttagaatatggattaggtttctaaaggtatacttatgtctgccttcgtcttcagaaaacaaagttgtatgtacactttaagaaaggtcttagtgtggtaaacgtgagggcaaaccaaagtcctgttacttcttttgtcatatcattaaagcctccagacggaggtttcttcccattatgtgatgtgcagaatttcagatgtcagtcagcagctgaagtcaactgttggtccaccaggcctctaagctgcagcctctgtcagcttggggacagtgggatccatgtgacttgcctgctactgcccttgattgggcagatcacagagcagatggcctgtgtctagagtacaaggtgttaaggctttttttttggggggggaagaaataattcacatgtgctaatattcctggatgtttcactgataatataatatagaatgtatgaaaaaatcaaagtcaattagaaccagaaatctcctgatactggatgattctatacataaatatcttgcactaacagcaagaataataaaagttgtacaaaaaatgtctgttcttccccagaccatgagctccatggaggcagagaccttatttggttggtttactgcccttccccaatgtttctaccaagctgaacatgtatccagctctcagtgccccattgagttgaaataaattacagtgacataaactatgttcttcatcaaatgctggacaagcacgtttctcaggcaacttctctgggatcaacataagaacagggtgatgaaatgtgagaagcagtgagggcaaggacttgagcctggtgcctacctaaagtttacactccacaagtattccacccaacacttcagataccttctcttctttcaaagtcaacagtttatgcccattgaaaataaatacacacacccactcatgcccataggcatgtgtgtgctaccagaaaatatgtacatgttaggctctttggaagcagtggtagtttggtgagaattgctgcattggctcatcaacacagacctgatcgcactttgatttcatatcttgctatgcagggctcccattatctgcctgccatttgtgtgcatttatgtttagcgtcaatttctcctcccatgaggctataatctgccttgtaaggagctaaaatgggaaaagcagttagaatgatgagtccagttggagcctgctggggaacaagacagtcatcacaggccaatcggcagtggagacagggtggccctttatcacacagaggcatctggagactgagagagacaaagcaacacagctgcaagccgaccatgatctgctggaagcttcttcagtcataaagcaaaggacagtaattctgaatgacaatgtaggaaaacaaaaaagaagaagaaagaaagaaaatggttgagcccagacgatcatttttagttacggatgtcacaaatggtgattgctggtagtgaagtatctgaatctgaagaccagctgtatatagtatgtgtgtttatggaggtgtgtgtgtgtgtgtgtatgtgttggagaagacctgcatgcctagttgtagcactagccagaaattcttgtttcatcgtctagaatgtggccagaggtttgcctaaattctcataagtccattactgttcttctataaatcaggctgcctgttttgcataattcaccaggtaattcacctatcactaggcaaggcagctgccatggagtgcatgcaggaattcccttcattgactcaggctggtaccattctcagcatttttgctgtttatatatttttattttggtctcggttttcctttatctaaaaacgtcaagctgggatggatccttggagatgctcgcttaaacaagttcattacacttaaaatagttttacaagcacaagtgaaaataatgtaataattgcagcagattcttagacctccactggatcctgggttgcctgtttcctttactcagttctagtttctaagtttattgctgggttttgatgtatgtatgtgtgtgttaattttttaatatagaatatgaagtttgagggaaaactattgcccttattcttgtcgatttgttattcgatcttttcttttcctctttgttggtatgtgaggagttgcagagcaaagctgctgagatcttatatttgactgaggtttcacaagctctgcgagatatcctaatcttcagagtgacacctggtttagccaaccacgtggaaaaaactaagggtttagatataaccacattcaaccacagcctttaccttctcccctgtgctttgctgtatctaatgacggcccagaaaggtgcaaagagagacttttcagaaaaagcataaaaacaatcaagaaggaaaaaattgcttggttgttttctgagatacctgaaccagaagcaattgagtatttaggtgtaactttctatgacctattagaatgaatgccattcttatggcttaaatttttttcaagatgaagagggcacttatatagacaaagaatatatttcccataaagatatattagcacaattctaattaatcttaaatctaagtttttgttccccaagtccaatactcagtctagaacatatgcccttttctgtgatgcctgctggccaccatgtatgatcatggtatattgtgcattgtacaaagtgcccagccaagggctgaaatcaactagtgctctacttatgaggaattaatccaggcatggcgctgtgtctaccccagaggatgtgccttttctaattttcgtaaagttactgcaatgggccagccctgaagatatacagataacagaatcctatgacttttagatgacattagccatcatgagagcctgcctctctgtaaatggtgttagggtgtttattatcagcagcattgggaatacagttgttttgatgtgttttctgatgccctgttctaaaattcactacttctctgcaggctttggaaagtgggagtgtaaccactggtcctttgggttctttgtgaagttgtgctaaccataagatgccgcatactctcctagtgaccacagtttttatgggaggtgatgtacagcagcaaaagtctaatgtaaatctcatgttggttcttccagagcaggggcagctagagtctaataatttcttgggaagagtttctgtacctggaaattttagatgtatatcaaggacatgtgagcaaatgggaaatctaattgcccagtgcctctggagcaaagtgtagagacagaaccagaatgttttttaccggcacatttctgtattaaactaagggagggaagctctttaactatatgggaactttttctcattggttcctttaagtgtcttaaaaaaactgatgtcttcctaagagaacttgtgaaaggtggtaaaatgtttaattggaacttaagaataacttcctactgaatagctttgttgatttcactttcctgtggggaaaagatagacattgacaaaactgtttcgatgagaattaatcatagctgtagatttcaaggtatgttatgatactaggtttcatctcctggatcttcctcctctacattaaaatgattagaatgataaactcaaggcatattaatgatccctaatcaatgtaaaaaaattatcatttctcttctttatgctgtatttactgtcagaaatacagacatacatattaggaagatttttcttgaagggaattggcacaaaagggttgagacctttaattaatcaaaaaattgaccattccttgaaccttgattgtttggtatcattaacaaaggacatgagacaacatgttcaagctttataatttgctggaaataatattttctttttttttaaaaaaagcaattttttgttgtaattgttaatcttactatatatttgtctcctgaaaatggtgttatttgccactccttctacgtattaattggtgtaagctcttaagttatataggatagttttaatttctccaaaaagctgcctaaggaaagtaaaacaccataaagaaaagggtatgtacccaagaagtagcaagaaactaaagagaagagattgagatattatcatgagaatttaataagagaattaaatatctagaaaaatgtgtacatacttagaagtagtaaacattaatttcctttcttccatctatagttcacctctagatcactcttttctttctttagatcatcagtatccaagattggaaagagtaaatgagtgttgataaatgggcactctcttgttctgttgatataagcttaagttggggtagcttttctggaggactgcttgacaatatacgtcaaatttatattgtgatgtcctttggccatgcaatttacccttcctggaatgtacgctaagtagataattgaataagtgaaaaaccaaatgtcttcataaggatattcaccatagttttgttgaaaattatttacaaattggaaacaatctaaataaatgtcaatacaggaatagtttaattgcatatagaactgtacatacaatgtaatcctatgcagtcactaaaaatgaaaatgtataggtgtattgattgccctgggcaattaccataacgtataaatgaatgagtaaaagtatcacagaataatactcttccctcctaagtaaatcctcaccaataaatcctattatacaaggcaaaacctgtatattatccctatcccctaattttcatcatctctcatatctaatccaccatgatgtctttttcattcctaagtgtgtttcagatcatccacttccctctaactctatcactgtcttctggtccaagcttggtattcaattaatacttgttaaatggattctgaatatgattccattcataacagcacacctatccacgtacgtatgtgaagacacaggtgcctagagaggtgttcactgaactactaatggtggtttcctcttctgtggtagaattcagcattatctttatttttttatttgaatttctcttgttgtttgaaatatttttaaataataatgtgtaatttacccctctccaaaaataaaacttataaaatggggatgataactattattctacctttctcactggataaacatagtggtcaaataaacaaatactcgtgaaagtcttttataatgtgaaaacaaaggtttttttgttattatgtgcaataataataataataactatagatactaaaatttgttgaatatatttcctcagtattttgagtgtcttaactcatttaaatctcacaataagcctatgatactataaatatacccatttcaaatatgaggaaactgaagcagagacagacgaaataatttatccaggtagacacagccagtagagctgaggcaggatttgaccccacacaatcaggccctaggacccaagccctaaccactgtgccaaaatcataatacctgcaggaagtggcaaatgttgaacttagctccatatatcagactcttgccactgtgaagcccttacagataatttcttttcttttttgagacggagtctagctctgttgctcaggctggagtgcagtggcgcgatctcggctcactgcaagctctgcctcccagtttcacaccatactcctgcctcagcctccctagtagctgggactacagccgcccaccaccacgcccggctaattttttatactacctcagttaatttagaaagattttcaggcactgatgaatgattttgggagtaatcccaagccaaatgacctctgttggaagtaatttaatagatgtgtttaaatattagaggtgggtgagatggtgaagaattaacatttgaggaacatttggtatcctctgggcaatatgtagacaccctttcaataaatcctcacaacaccccagtaagttatgtgttatttgtttctattgtaagttgcagtcatagataaggaaactcagatatgtattaagtcatttgctcaggtctttacagctattaagttgcagagttgggagcccatctaaactcctaagatcagggtctggatcacctctattattttacattgggcatctatcatccaggacctatgtgctgcaggaacgtaattaagaatgactttgacaagataaatatttggggacatgaagcctgatcacagagtctaccagttatgtggacttgggcaagcaacaccatgaacctcacttttttcattctcaaagtgggactaatgaaatttttcctgcttctccaaaagataattttagtcactctgttggtgagttttgcaaaaacattgtagtataagccttcacaaggaattacagagaagaagataagtcttagcattcaagaagcctggactgtacctgtctcaaaattattttatgctaaatgcagacaattttctctatttggagtttctttcccatcttagttggcctcttctcagttttctgaatgaagcgtgcaccctcggatgtctggcctttactcctgcatgtcttccggtctggaataccttcccctccctcaggaacttaaccagcttcaacatgcagccttcctgaacactccaacatgaagggatgcccttctgttctaaatgtccactgcactgaacaaatcatttaatacaaatttctctgtagtttatacagaggatttgtgtttatgggcttatatgttttctttaaaaataagttataaagtttttgatgctagagcattcttttgtatccccaggagacactcagaatatatttgttgattgttttgattttaaagaaaaaggcggaagaatgaggtaaaatggccactatctgtcaggaacttcatataattatctctgcccagaaataaattaaaatagttttcttcagccagttgcaatagcttatagaaaaaaattaccttccctagatgtcagtgtcccaatttggaaaacagagtttggtcatatattttgtccgctgttgtacaacctttagaaacataaaattcaagaggaatactaaataaaaggatcaatcaatactgagttcagctttaaaattatttcatctaataatgctggttttcttggcagcactagcaagggctagaattttttaaaaatcatccttatatatgtattgattgaatttattaaaatgctttattaccatatccatttgcttataagaaggcaccctgatgtgtcctatatgagtttcaaaacacaattaaataaaaccatgcagagcaacaaacactacgtagcatttacaaactgcatttgtattcatttttatgtacatgaagggaaaaaaaacccaaaaggttgaaagccttctggagtgataaatgccacaatttagtggaaaatacacattgtaatttgagaacatctcccactaagagtcagtgtagctacagggacaagaagcctggtgctaaattgtctgaacattgatgtcccttcaaaattcatatgttggatcctagtacccagtgtgatataatcaagagataaggtctttggggaactgattaagtcatgaggggttctccatatgcatgaatgggttcatgctcttataaaagaggttgaagagagcaccctagggcctcttgcccttctgcttctgccatgtgagggcgtagcaagaggcactctttatgaagcagagtgagcccttgccagacactgaatgtgctggcgccttaatcttggacgttccagcctccagactgtgataattaaatttattttatttctaaatgactcagtctaagaagttttgttatagcagcccaaacagactaagacccctggcccacaggctcctgagcatctcagtgcctttgaggctataaaggacctcgaccttcactttcagcacatgttcaagtaaaagagaaaaatgtgtgtaaagaagtgcccatacccaataaacatacccatatttattgcaaattatcctctaaactgtttcattgtggtcaaaacccaagttataaatttttagtgtccttttaagagttcagtatttgtcaacctacggtcaacatttgcatcaacaaagaaggtaagatatgttgtgttatctttgtcatttttcagctgtcaactaggataggggccagaaatagcaaaactgtaaacttgaaattgtttcaggaagaagtgtaatagctaaggggtgtctatgaaatggaatgtatatcaatatgaggtaagacagctggtaaaaaataaaaaattagcaggaggggcaccggattcatgtaccagggaaaataatgtcatgttcattgcccagagagattcccaggaattagagattgagaaatattatttcttgacatgtctagaggctacgtggatagaagttctggaaaatgtttgagataaaggccaataaaaagcaaaaggacctgaggattctgtttattcactgaacagagaagctaaaaattgggctctcattttggacaaaaataaaagccatagtaataagtaaaataaaataacctaccaggtagcagagctcttagcaaaggattctgcaagcaaaaggcaggtgtgaattgggaaagtgagtctgggattgaggtgaggtggggttaggtgtagaacagggctatgaaggtcagggcagtggaaggtttgattctggaaagcatggcttcaagggaaaacttgagtggtgaacgggaaaatctgtgaggatcggaaatgtaagtctctatacttgctggggaaatgagcaagaaatgaaagggagagagccagatgacgcagctggaagcagaaatctgagcagggggaacctggcaacagagaggaggagctggaagaacaggggcagatcagatctagagccaagctgtattctctggccccatactttaatattctacctatgaggcgcagtgcctttgggtgttgttcataaaattccagtgttgaaaagggtttcagacattgtccgtgaagctcctctatccatcaagccctttgcaatatttacagtaaggaaagtgggagcgcttcagaaagagagagagagaaaaatgaaaattcctagccccatctagacatgccttatcagtgagttaggcgaagtgcacaaaatttaaaagtaagattctagttgtttgtattttagctattcacgttgcatcacaagagctccacaactggatttaaataattgtttctgccttagcaatcttaagtgtgcatgtattgttcagctattcctttaggggaaagattgctagatgggaataaaatggaaatgctgttttctaaaagttgtggtcttcatagggagatagctcttcacttcgtgtgttagtgatgaacatttgcaagctgtagagctgtagagaacactttgtggttcttctatttgaagaaaccctgatggctttgtcacatattccaagtttaacttttatttttaaagagtttatacatcatatttgaaaaagactcaaacatgtctagagttatatgttagacactaaacatacttgaaaaagatttaaaaccttggttttagtcatctgtaagtactctattttaaggacaactaattaatacttataactcagataattcaggagacgatcaatgattatgaaataacttcctatgacatacttttaaatagtaaatgccttcactgcatgtaattcacacatcaatatatactaaactatttccattaatatagccagtctccaatttacaggaagacattatgtttcacaagttgattttaagtgaattttttgtaatatagaaagaattgtcccaaagagtgactgctgaactggttaaatccacaaaaaaaagcatcacatgaattcatctactaggcaaatttgctcatccactttcaagtcaaaaaaaagttttaaattagataaaaacctgtgtatcccctttcttagtaaatttgcctgctgtgataaatatacacgtgcacacaaaaataggcatgcatttttaagaggagtagaaacccatttgaacttgtccaggaactcaagtttagaggctcaaatgtagagaatactaataaccacctataataattcttttggagaaggcatactgtattatgcctagtgcttaataggacaggggatttttcatctctcatgtgcctgggaatgagagccaggggcttcccccaattctaaaaaaattagcaattcagcagaatctacagtggggccaaattgtggctgggatttgggggatttcatcaaagtgggtcagaggtagaggtggaagagaagcagaaggccggtgggagtaggatacagtacaggggcgagcttccagctggctccatcagttgaggaagaagaagcaatcccaggaggtccatactcttgatattttatccctcctctcactaaggacagctatgccctttgtgatctgccctagactgactttttaatacagagaatgaaggccagtacagaaagcaaggagagaaagaagagaaatagatgctaagttgtccccttgaggaagaatgagggaaaatggagttcctgccaccctagtctattagctgacattgttactcctaattcaaggtaattattggtatgcaaagaaagtatgtattaactatatgtcaaccagtaactccctgaaatccacttgatgatagaaaattagtctatggccatatcactgtgaatgcaccaaatctcatctgatagcaaaatattgcatacatttcttctagaaactaagaattccaatgaaaagctatgaaagaatcctacttaggtctgaatttccatacattcctggtatctcagagggtggcaaggttagaaaacttgagaatctgtgggcacactagggatgaagtgatagtattctttgttggatatcaaaagaaatctaagcaggagaaccaaaatccattggtggaaccaaaaaaccattggtggtctgaaaagttaggtgggagaattgaatagcttagttctagggatcaagtaaccaccctgactattgagcttcccgataagacaacatgatggaaactacatggtttcatccaggtgctgggaacaagtcctactgaacattggcttttggacaaataacaggcagattctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctargccatawtgaggaaggccaatgcarktttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttccacttcctgccttccccagtcccacttcctctcttccttcctggcaccccccagcactcccttccctccttctgttctccagtaccttcctttcttttcctttgcccttctctcttcctccttctctctttattttccttccttccttcctctgcaaggccttcttactagtttccacccattttcctatgtaaagcgattttgaattctagccatctgttaatacaaggcagtgaaaaatgttgaagtcacatcaaattccacttgctctgccagttaaaaatacagatgcttcctgttttatgctttcctctcactttctctagagtttaaacatgaaaatatgttccatgataaaaaccagcacatattccctttcatcaggaaacatattccaaacaatgaaaggaaggggagggggattattttcacaagtccagcaaggatacttggatgttgggggaatcatttgtagaaccataatttcacagagcaagaacataattattcacaactatcacattttatagatgaagaaactgagatcgcagggaattgttataattgttctcatatgtgctgcatatcgacttgccaaaattcacatcagcttaaattttcacccaacatgcctggtcctcaattgttccacaatactttttgctatccgctgatttcagaaagggttcttttggctactgggagaggccaaatcactaagcaatggataattaacctgaaactcagtaaatgcactggagtgaaaaaaaaatgtgagactaagagtcaagacacctgggttctagtcacaaatctgttactaactacccatcccaactcatagcaaaaatttttattaatactcttgctccacaaagagactagatcaaatggtctctaaatttactttcaactctttgaatcttgagttttcttccttcaattttctgctgactcagagcgtatagccttggccaagttatttactgccataaatctcattttttttccaagatgaaagggagaataacacattcccctattttcccagcatatatatatatacactatataatcttgcattaaattgactatctttagaaatcacattaaatcctttctatctatagactttggattagtcactaaagctagaataagacatgggccatatcattaggcaatgtctctggctgtagttgtattatcaaacactgcattgacgcttgttcatccttgcttccatcatacctttttatgtaagctgttctaattcttacatgactataacatggagcactgtatgtcaccatatctcttcctctcattgaatctgatcgtattctaatatctcctatctcaatgcctagttcttcacccattttaccaatgcaatatagaaactttcttactgcctttttatttcttacttttcttttgaataattcaccaagttattattgattttgtctgcctgatgtctttcaaatttatccacttttctctcttccatgatatcctaatctaagctaccatcacccctcaactgaactacagcagtcaaaagggttatttccacacagcagtcaaaaggattgtttcaggtgctaaatttggcaatgtcaccccactgaatggctttcttctggtcttaaagacccgattccagaacaaaacttacatggtaggcagctcctggcccttgactgtgtttctagtgtcatagtacatgctcctgaccttttgccctctttgagttcctcctcctcactatcctttcctggagattcaggtttggcagttccccggggttagaatgctcctccatgatttacctagttgctgcttattcttctggttttgtactgatggtcatgttctcagagcagccttctcagcctccctgggtcagttccctccatcatgcaccatcattgtgccttgtatccttgctgttattatacttatcagagtcgtaattttacatttgctcatgtcatactttttagattatgctttgctttcttctccttcaccagagtgtaaactctatgatactatgtctatttttatgtcaccattgtaattccagtgcctggcataatatctaatgcatagaaggtgcaggctaaaattctattgaataaataatgaatgaaaagaaagaatagaagtgcctgagttcaggccctgtatccccattccctcatatatgtggttggaaccatagaaggcaaaatttggtgttaaaagaataaagctggcaagcactgatgtgcctaacaggataggaagttcagaattcttttttaaaagtgttcaagggcccaggagtgcctggctaacataatgagacccagtctctacaaacatttaaaaattacacaggcatggtggcatgggcctgtattctccgctactctggaggctgaggtgagaggactgcatgagcctaggaggctgaaggcttcagtgagctgtgatcacaccactgtagtccagcctggtcaacagagtgagaccctatctcttaaaaaaagttctaggatattggagttgataatgtttgtaaagatcaacgctaacattgcctccaaccaagtctcaatatgctccaaaaagaaatacttcaaattaaaactcgtgtgtgtgtgtgtgtgtgtgtgtgtgtgtgtgtgtgtgtgtaaggagaggtggctcatacctgtaatcccagcactttgggaagccaaggcgggcggatcacttgaagtcaggagttcaagaccagctggccaacatggtgaagctccgtctctactaaaaatacaaaaattagcgtgctggcatgcacctgtagtcccagctactcgggaggctgaggcatgagaatcacttgaacctgggaggcagaggttgcagtgagctgagatggtgccaccgcacttcagaaacagagtgagactctgtctcaaaaaaaaaaaaaaaaaaaaaggccgggcatggcggctcacgcctgtaatcgcagtattttgggaggccgaggcgggcggatcacaatgtcaggagtcccagaccagcctggccaacatggtgaaaccctgtctctactaaaaatacaaaattagccgggcgtggtggtacatgcctgtaatcgcagctactcggtaggctgaggcaggagaatcgcttgaacctggaaggtggaggttgcagtaagcagagattgtgccattgcataatggagtgaaactccatctcaaaatatatatatttttatatatttttaaatatatgtttataaatatataaatatttttatatacatatctatatatagagagaataaatatgtatccacagagagagggagagagataccaagacaaacttataattgctataaattcaaataagagagaagtcagtaaaacctagagtaactaggaaatactccctagaggccaaatttgacctgtgctttgaaaggtaattacaattgggacaggaaacggcacggcttctttctcaaagattgattattctgactattctccattagctcttccttatacactttccactttcccaaactctgtcccgggatgctgacatgaaccacgtcaacaggactccctcacatcctgtcttcaagtagcatttgcccagagagaggcctcaggcaggaggttgtaggatggaaggagagatttgcaggcattcatttccctgctccctccctgcctggctgcagtgggtagtagctaattcctcttctgaaggccacagctcctggtggatgcccccttctcacttacaactgagcttctcagtgggttaccccttcacaactagggttggtcatggctttctgatgctgtgatcacccagggtacttttaaactctctacttatccgtctggggtgccatgtgttatttgctaagaatgaggtaataggaattttttaaaaaaagattaaaataatactatcagcctgtcaatggggattcctcccacccccaaaaatagagttgttcgtttctctttgtttggtttacatgatatatatatatatatatatatatcatgtatatgtatatgatttacctcaaaacagatcacaaagctgaggtcacttgaaactgactattacaagctagctggtagaattaaacttgtttccctaagtaaaatagaaaaatttggccaagagataagaaaatagctgcccctcaccaccacaaacacatacatacacactatactgaatggatcttcatagagagtaagttaataagaggccagcccctacctctgcttccctccccagggacatacatataaatagttcagttatgtctgacttaatagatttgggaaggaggaaacgtgagaggctagtccttctgaagggttgggaggtaagggtgagggaagggaggggagcaaaattacggtactgggatttggacccagataaaagctgctttgtcacatcatcccgatgtaaaatccgtgcatctgagagatagcccctgagccaccacacaggctcctcccaccagagtctgtctggcaggggtcagtgctgcctcgctgtggattagagggagtcatcgacatgtcatctgccatcaaccacacttattgtgaggaaaagaatgccccatacacatagaggccacccttgggatggacttttgagttgactaaagagtaaaaatcacaatggatcatccactagtcagcattattacctttactaacaaaaccagtagcttagccacgatcgtataaaacaataaatgttggttaatttctaaagtacattgattgttttagtttttgttttaagaaaaaggcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactctggaggctgaggcaggagaatggcgtgaacccaggaagcggtgcttgcagtgagccgagattgcgccactgcagtccgcagtccggcctgggcgacagagcgagactccgtctcaaaaaaaaaaaaaaaaaagaaaaaggctttatgtggctgttgggaataggattatttcctctaacatttatcccagtatttttaaaataaagaaacatttggtcgatgaaaagtatagaatatttgtggtaattataataagtgaatacattacataatgtcctttgtgaaaaaggcttacattattataatgggaaggaggtaaattaatctgagtagtattagtataatagtcttagtaattataatggaatgaatcaccctatattataattatgattcaaataatatatatttttagagatcaaccgtttcatgatgtgctggaatgggatgtggtaataggagagcagtgattttggctaacacattaggtattctgagtcaatttggcacaacagcagaaattattttctctattgtcttattgagaagaaacgtcctaagaaggatcttggggaaaataaataagtatgtgagtctgacataggaagagagggtttcttcccctgcaaggcaccttgtgaaagcctagtggggagaaatagtgggatgatgaaggatggggcaggttacttctggaagcaaaattcagatcccgagtgcaggtgttgttcaggcctctgtgccccactgtaagtgtgctggcttcattgaaagggatgagaataaggcagacacgttcaaatatgcagagtgagggaaaatacaaagagcatatttgatattggttgaatgattgagaatatttgatatttgatattgattgataattgatgagcacttactgtgtgactaggaactgaactaaatgctgccccagagatcattcttatttatgctcacaccactcatgaagcaaaccattgttgttattttcattcttcagatgaggaaactgacagtcagtgatgctaagaaacttgctcaaggtcactacagtagttattgtgggcctggggtttgaattcagcctaactccagagtctatgaccttaaccattaagtgaaataagtgaacatcttcatgttcaggacatgtgatgtgtgtgcacacgcatgtgtgtgtgtacaaaataaaatatttgaagccaacaggatcctaagtctgggtgggtcctaatgccagagtgcttagggacacttcctttttaagcaagatagtttgacattgtcagcttttaattgtaatttaatttcttgtgtgaacattattaaaatgtattaaaaccagatcaaaacatccaagacttttatccccctgatttttatagaagccctctgcttacaagcacttaaagagagatgaatccttatttttcctctggtaagtgatttctaaattcccgtagaaaagcctttaaaaagaaaactcaactagctgcatttatggacttgaatacctacactctactaaaattattgccttttcttaatgatgttcctgactcatcctgaaaattgatcatatatgtataaggtgatgctcactttacaggtggagaatgttgtagccacaagtaatgaagactaatatatagatatttaaatccacattttgtccagaattctcaagcagggagttctaacctagccccacccctcattccctcattaagcattgttttcttagaaaggattaaaactggtaatatatctgtaatcaattagctgacatgacttaaaattgataagtcatttgatgaattctcatctcaaattccgaatgaataaacaatgagaaatgggaaagcctttggcagagagagactcattgaatcagttaattaaggaaagagaaagagccagagtacaagctatcaatatcacctacatgggtcaagaactcatccttatgtgtgtaataatagagctactcataaacctgaaatgatacaattaattacggaagttatagaatattggagcatcctcgggtgaaaaataattgtgtctatattataaaagtatgcaacataacacattttatctgcatttaacattttgttggtgtttcatgcaaatgaaaaaaaaaaaacactgtttttatgatttagccaaaccatgctaactctagtaacaaccctcccaatctcagtgttttaatgcaacaaacagttgtatcttgttggtataaattccactgcattgttcttggttgggttgttccttaaagaggatactcaggaatccattctcttcctatactgttccagaggaagatggctcctccattttcaatacgtggcttcaaggtcacgctgacgttgttcagacagtgttctgttggaagagtgagagaaaaaagcatgtacatacaattccttccaacacacatacacttaactgctttggtttgaaagtgacataaaccttctgctcacattccattggccagaattcctcacacagtccccacctggcttagtgctcaggaagaggaaatagatttgatgatcatctaggcaatgtctgtgatgagattggttcaaaaaatgtaccagtaaaaataaaaataatcctgttcattacattccagaaaatgaactgattaaagacaaatatgtatgcatcacttttctctttacgtagtgaagcaatgtgaaaaacatattaattgagctattcatggcaagacttctctttataaacttcatacatctgtcactaaattgatatgaaagaaatatttgatctcagaaagaattttatctatcatgatggaatgctggcagccaaatgtatacctaaaaattgctgaaatattggagtaaaaaggaatagttagatcgatcatcttaattttgtgaaagcatgcgtacatttttcaccttggattcagttgtgttggcattttataggcacagttataaatttgcctaaaatacagaatggcattacaacaaaactcagactcatggtgtaatcattgtttttttcaaactaaaaacaaagaatgaaaaataaaaacctctaagaacaaaattactccatttaattaaattaaacagacaaaacttggaggcatagtagagatggcaaggaaaggcctcagaccccttacccccatccaggggaaatatttgccagccactcctatcttcagcaaaacttgagttatgatgtaaactcaagactcttaaatttgtgattaatcctgggtgtcttgaaaattggagagtgggttagcaaattcatagttccccaaatttgtgctatctactgctgttttcttgtggattataagcttgaaggaaatgtgctgcctagagatatgagctgtgtgtaattactcccacctgctgggtaaaatctttattacatgggcattagacttcattcccatcgaggggtgaggaggggtgcaatatgaaccaaccacaccacaaggcttgtgaacatccttcctctatggtgtctcctgacacttctttccagcttccaaatgtgatacaactttgactggaaactgtgaaccaatgtgtatccaatgaaccaagggagatttagctccttaaaagaaaattaaatgtagaaagatgtggaaggatcaatgaatcatatttatccaataagtggttcaacaattacaagagcgagacaggaagggaacccttccaggcagagtggtcctcagctctggttttccagcctagagacccatgtggcaggaacttggccttcatcattgaataccctgcatacacccttcctcaagcctcctttgtatgtgtgagagcactgacttcagaaacagaaatgagtttccagccctcaagggaactgtttgctaaagattggcaggagcccacaagactacgacacagtctttgatgagctggctctccaagtgtgggcagacttttgtttctaagttattgggaggctttctgtgggtataaaacctgcaaaaaacacaagcatcaatgttgccatattaataactgctttcatccttggcaagaagaaaaagaacgtggggaaaagagtcaggcgcaaacatggtttgagttttattgtcttttacttgctcactgcctacacctcccaccagtagctttggaaagagagtttcagaaatgttatcttatgttttttatccctaagaatggggtcatagtcttcaatttatgcctaaagtgtttaactactccttcttaatttactcgctctgcccaggaagaaaacagacataacttgcaaaggtggaaacactggtacgttaggaatatcattcattttcggattcttggcccttgagtttcactgttacttaattgacaaagctgagctgtttcatttcacgctaggaagtctttggttaaattgcaggcttgggtttctgtcctttggcagtggaagtaaagagaaatcagaagcaatgtagcatttatgaaccactggctcctctaactgcctctgtggcttcaaatcctgatgatgtcaattgtggtttgtgtatatgtacgtgtgtgaatgtgtacacacatgtgagtgcgtgaacattcgattcatttctcatttttgttctctctcttttcccctcacctccggaccttttcatccttctttatgttctgttgccttcatctcttagtttttctattctatgccccttttgtttctactcttttcatctgacctattattatgtcatcagctataagcaccatggaaaacactagtttcatcatctccatctgaaagaaaaaaaaaaactcaacaagggagaagctgaatatatctgtcttcagtatctatctttgaatttggaatgcttcctgccaagaaaattatattctgaaactccttagatcttgcagtcttcatgaagcacaccagccaatagctgcctcctgacatcagctcagatatctggttgacttttgctgctagctcttccagccaatgaaagtagataccttaggccagtgttcccagacatttaggttttatgggataataaaatctccaggagcaaaatgaagaggctgatatattgccttctctttaaattttaacacttttgaaaaactgccatctacacactaccgctttttacattttaacacttttttaaaactaccatccattgtcatcattattccataaaaagaggtattttaggaaggatactcacaacataagttggataaatttagcaattaaaaaagcactgctttacttttatcttctcctttaatcaaagatgggatatgaatatcaaccagcattgatccaattttaggcccttagttccaataaaattgttccttttcccatataaatggttatgcctttgggccaattgctctgtctctcagaggttattatatcctgttgcctctatattgaggattgctgtttcatctttggagttacaatgtcccaaagggatcactgatacattcttagctccagtatataaatagaggcactaagaaataaaatgagagggttttgacacctctccctctcccccaccccccaacacacacaaacaagtaaatgggttagcttttatttctacaattgcacagcatatttagtgagagagggaagttggaggtgggtatcacacatgtaagatattgcccttattttttttttttttcagagacagtatctcattctgttgcacaggctgaagtgcagtgcctcgaacatagttcactgcagccttgaactcctgggctcaaacaatcttcctacctcagccttctgagtaactgggactacaggcatatggccaccatgcccagataactttttaaaaacatttttgtagagatagagtctcactatgtttaccaggctggtgtcaaactgctggcctttagtgatcctcccattttgccctcccaaagtgctgggattacaggtatgagccactgcacctgtcctggcccttattattgagtagattgtagtctaatgaaaacatatgagtataataaacaaaagaaaaaagaaaacatatttagccaattcatagcaaaaggcagacagaagtagatgctgaatagagaaacaagactgttagagggcagagaaaggagtaattcattttgctggaagaatcaaggaagcaatcacaaaggtttaatgtgtaattctgaatttatgtgattgctatataatcattctgtttcatggctgcagtgtaagctgtgtgagggcattgtttgtatcagatgtctgaacctctttatctcatcccttatcatagtgtctggtatctagtctataacccataatatctcctgaataactgaatgggtgcctacaatgataagtggtgtgaaagataccaagaaaatcaagtatcattcattgccccgaaagcacctgtgagcacataggtttgcaaacatgccacatgtgttcggtcagcccattgcttgtgtacatgatcatagatggtcatagggatttacttcattctgaaatggaataatttcatcctcaccctgctttaccttaggtaaagattttgatgccatttttattaagacatttacttggaagtaaatgtcatgctgtgaagagccattatagacaaatattgtagccacttgccaagtaatgacttatgctgggaagttgcttaaaaggctgattttattcattttatttgctatacccttgtgctacttagagaagggtagagaatgagagaggagcaatatgttttgttctcttttttttcataaatcagtaattatttgcagagtgttttgtgtaaagtgctcagctcacaactggaaatagaatcctgggttagacagtggccatagtgatatttacatatctccagcttgtagtttgccaattgaaatgcagacatatgcggaaattgcctcattgtcattccttgtttttgtaatattatccttggctctacggattcattttttttctccttctactgtcaacactgttttagcagtgagttatattatccggtgacatcagagaagcaaagctacatgtgtcagcttggcaggaattgtccacttacagcaaatttgtgacaagttgtatttttctaccattttcacctggagtgacgaagaatctacagttgagggagacaacatggacctcccctgatggtaacagtgctatgtccaattgagctgctgttgcttcagtaccaaagaggaaggagctggtgatctttgaataatccttcccctatgaaaagtaggaatgtatccccagagttcattgtctgtatctgtaggtaatggaggcttaactggcattaaaatcatagccagtttcagacccattaagtttaatggtttttgtaatgataggctgcaactgatggaataaccaaaagaacaattcatggactgtttatggaagaataccttcaccattcaaaatggacattaaactatggctggtttcattgcaaggcaaaagttccctctttatcttctagttaggtccatgtgcagcccaggaggtatgtaaaagctatactttaggagaaaagttgacttgaagcttttaagctaatgagtttgaacttggcatgttttctattatcattgtctttaatcagtggtgttatataataaggagctaataaattaatctaagtgtaagtcaaattaatataagttaaagtcaaaatccagctaggcaaagccagataggcatattaaaatggcagcccctaccccaattccttgataatccattaaaagtagaaagttttggttaggaagccacctcctgttacgtaaatcagaatgtaagagccatgagattagggattttcatttgttttatccacttttatatcctcagtgtctagaaaaatgcttagcatattgcaggcactctgcaaatattgaacatacggggttgatgaacatataacccattttggttgatgtagttttatttcttaagaggtaaaaattctttcagaaaaagaaaagtaatcatttctacaaaataaccctccactggttgatattcttcccagatctacctttcttcacacagatctttttttaagagaaaaccacagggatatgtggctggtgcaatcaatgataggtttgggatatgataaaatgtaggaaatggctaaatgggagagtacatgatttataaaatagaatttaaaataacagccctcaacagcagatctttgccagcagcacatgatgggaaaatataaaccccattctggggatggcatctggtacagattgagaaataaattgggcagcgaaacagaatgtgtcttcagtggtccttaagatcaaaccaccaatgataagcatggatcattggagcctccaccttgctctttttgaaacagctaaaatcagcaagggaatgaaaaggaaatggctttatcatctgtgagcagcttgcccctccctctggagatccaaatctccaaacatgcattttgatatactttgggagttctctttatctagtaatttcatttaggggaaaaaaatatagctctccctgcccacatcccacattgttacatcactgattcctcaccatgctaacacattcaataatctgacgtgcaactcaactagaagagcaatcacagccagtgatgggccggcatcatggagagtaaagacaaatggaaacaataataactgtggaagaagcagatctcaaatgggaaactcaatcccagtgatcagggaaaactccaaaggaaggatatgagttcaaaaaaatcaattcaacaaaaacttattgtctgtctaccatgtatcaggcatggggatatattactggtcaacacaatgtgctttgctgcctggtgcctgtgttctgatatctggtgtgcatgttctcaatggtattgcaagttgcattgggctagaatcatgaagtattatcaggggatttacttgaaattaaattagtcccattcttgtggaaatctggagctggcatatgcatggaagtgaaggtcttgttgctggttgaatttagtgccctctgcaatgaaagccaaatcccaactttagtctgtgactggggggccttctacaaagagaatgaattttaacaattaaccaacaatctaaattcttggaaagtgaaagtttctaaaacataaaatccatgaagacagaattagaaaatcaatgtgtcctttttggaggaagaggaaagccgctggctgaccacgtcactttcatgtttctactcaaatcttatcaacaaggcctttgttgaccattcatccccttcctaggcccccttatttctatgtctgtcttgtatcatctgacacattgtaaatgtccttatttatttgcttactgtctgtctcttcactctgaaatataaattccatcatgtcagggactttttcttcatcttccccaaatgatgtttgaagcctcccatctaatgctgagaggtatttccctagtagccctgtcatcactttcctaccactgtccctgttgccacataatttaagattccctgtggccaatgctgatgtcattatcatggacgtccttaggaaacgaaaataatttaagcttctaaaatgggcaaattcgatgtagagttgatgggtacatcacacacccatctagaaaagagcatctcaggttggtacctgaaacttggtagactccaccccaagtcacatggccaactgatgtgttacttcttagacatcctgctttctctgtccataggcctggttgggtggtctttttcagatactaaatcatggtacaattggttttcataaaactagtactctaattctacttttccagtagccttgagtaaaggaatgttgaaaacttgtagtgatgaaacgtgtaggatttgcgatttgtcggagtagggacaaaactatttgagaacatagtccagctgaccaaaagaaaataagttctcatattactaataacttttagggatccaataggctcaagaattctgaggttgggtttgacagtgattagtgtaaattaagtagaagtagttaagaaagtggctgaaattgaaggatcggttgtggttagtaaatatggaggattgaaacacaatgcaaacttgataattgataaccttcatttaattctaactaaaagcccactttctggtccaaagttggaactaagaatgaattctttttactctgagaggatatttacaaagaaaacacaaacacacaaactatgggtaacacaaaagcaaactagaatgatttatcttattattctgttatgggttgaattatttcctcaaaaaatatatgcttgtcttaaccccagtgctgctgaatgtgactttatttggaaatagagtctttggaggggaattagtaaagatgaggttatactcaagtaaagtaggtccttaatccaatacaactggtgttcttattgaaagagaaaagacaacgtaaagacatagacacacaggaagaacaccatgtgaagacaggcagtggtcagaattatgtatctacaagccaaggaatgcctgaggttaccagaagctggaagaggcaaggatcccctccagagcccttagaggaagcagggccctgacaacactgtgatttcagacttctctcctctagaaccattagacaataattttctgttgtttgaagccaccaaatctgtgatactctgttacacaaatcctaggaatttgatacaccttcctagacccaagtggggaagaaaagggagaaacaggtttagaggtggagtaaaagataacagcttctcacaacttgaggcaagatgcgtatgctgatggcagagaaaggagttggcattttctgaaagcctgtcagatcccctgctttgtctgggaaggggaggaatatccacagcgtcttagcaggtgaaatgcagcagcgaagaccaggtgcctgtattgttgcctctggttgtgcagatgaagagtcattaggctgacctcatctatggacccaactggaattagccctgactctagagccactggatgttcaggcaaaactgaccctaaaattctttttaaatgcattgcttaagccaagcattctcttattcaaaatcaagctgctgcattttcatgtagcatgaaatgcaattttctatttaaggtgttcaactaacttagggataggttgatggccaaacaaagaaggtttcattaagatggaaatgatttggagtatctagtctccaaagtgattgctctagagacatttatcaatccaccggtggcttctagtcgatatttggttttataggttggggcaaaagtaattgcagtttttgactttttaattgcaaaaccgcagctacttttacaccaacctgataatattccccagatccttccctgcttcctctcattagtaaccagagcaggctgagaatcacttacctgtctcttgtgttccacaatgcacactttgaccccatctagtctcttccaatatcatttactcttgtccattagcggattttctttacttcctgtgtgtctagcttgttggggggatagggaggagaggagaggctgaggatattttttctgtgtgtgtgtaaaggttattcaaattctttatcacttgcttttgctttttaggaagaaaaaaacatgaatatcttataacactattttttaaatgaaattgttcagcaaattatacttaattatatttttaattttaagttctgggatacatgtgcagaacatgcaggtttgttacattggtatatgtgtgccatggttgtttgctgcacctatcaacccgtcatctaggttttaagacctgcatgagagggtggagccaagatggccgaataggaagagctccagtctagagctcccagcatgagcgacgcagaagacaggtgatttctgcatttccaactgaggtactgggcttatctcactggggaatgttggaaagtgggtgcaggacagtgggtgcagcgcacccagcatgagccaaagcagggagaggcattgcctcacctgggaagtgcaaagcgtcagggaattcccttttctagtcaaagaaaggggtgacagacggcacctggaaaatcgggtcactcccaccctaatactgcacttttccaaaggtcttagcaaacggcacaccaggagattatatcccacgcatggcttggagggttgtatgcccacggagcctccctcattgctagcacagcagtttgagatcaaactgccaggcggcagtgaggctgggggagggacgcccgccattgccaaggcctgagtaggtaaacaaagcggccaggaagctcgaactgggtggagccaaccgcagctcaaggaggcctgtctgcctctgtagactccacctctgggggcagggaatagccaaacaaaaggcagcagaatcctctgcagacttaaatgtccctgtctgacagctttgaagagagtagtggttctcccagcatgcagctggagatctgagaacggacagactgcctcctcaagtgcgtccctgacccctgagtagcctaactgggaggcaccccccagtaggggcagactgacacctcccacagccaggtactcctctgagacaaaacttccagaggagcgatcaggcagtaacatttgctgctcaccagtatctgctgttctgcagcctccgctgctgatacccaggcaaacagggtctggagtgaacctccagcaaactccaacagacctgcagctgtgggtcctgactgttagaaggaaaactaacaaacagaaaggacatccacaccaaaaccccatttatacatcaccatcatcaaagaccaaaggtagataaaagcagaaagatgaggaaaaaacagagcagaaaaactggaaactctaaaaatcagaacgcctctcctcctccaaaggaatgcagctccttaccagcaatggaacaaagctggatggagtatgactttgatgagagaagaaggcttcagacaatcaaactactctgagctaaaggaggaagtttgaacccatggcaaagaagttaaaaaccttgaaaaaaattagatgaatggctaactagaataaccaatgcagagatgtccttaaaggacctgatggagctgaaaaccaaggcacgagaactacgtgatgaatgcacaagcctcagtagctgatttgatcaactggaagaaagggtatcagtgatggaagatgaaatgaatgaaatgaagcaagaagagaagtttagagaaaaaagaataaaaagaaatgaacaaagcctccaagaaatatgggactatgcgaaaagaccaaatctacatctgattggtgtaactgaaagtgatggggagaatggaaccaagttcgaaaacactctgcaggatattatccaggagaacttccacaatctagcaaggcagggaacattcaaattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagctgatcctctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcattaaacatggaaaggaacaaccagtaccagccactgcaaaaacatgccaaattgtaaagaccatcaaagctaggaagaaactgcatccactaacgagcaaaataaccagctaacatcataatgacaggatcaaattcacacataacaatattaaccttaaatgtaaatgggctaaatgctccaattaaaagacacagactggcagattggataaagagtcaagacccatcagtgtgctgtattcaggaaacccatctcacgtgcagagacacacataggctcaaaataaagggatggaggaagatctaccaaacaaatggaaaacaaaaaaaggcagggattacaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagaccaggaagagacttagactcccacacaataataatgggagactttaacactccactgtcaacattagactgatcaacgagacagaaagttaacaaggatatgcaggcattgaactcagctctgcaccaagcagacctaatagacatctacaggactctccaccccaaatcaacagaatatacattcttctcagcaccacaccacacctattccaaaattgaccacatagttggaagtaaagcactcctcagcaaatgtaaaagaacagaaattataacaaactgtctctcagaccacagtgcaatcaaactagtactcaggattaagaaactcactcaaaaccgctcaactacaaggaaactgaacaacctgctcctgaatgactactgggtacataacaaaatgaaattaagatgttctttgaaaccaacgagaacaaagacacaacataccagaatctctgggacacattcaaagcagtgtgtagagggaaatttatagcactaaatgcccacaagagaaagcaggaaagatctaaaatggacaccctaacatcacaattaaaagaactagaaaagcaagagcaaacacattcaaaagctagcagaaggcaagaaataactaagatcagagcagaactgaaggaaatagagacacaaaaaacccttcaaaaaatcaatgaatccaggagctggttttctgaaaatatcaacaaaattgatagaccactagcaagactaataaagaagaaaagagaagaatcaaatagatgcaataaaaaatgataaagggtatatcaccaccgatcccacagaaatacaaactaccatcagagaatactataaacatctctacacaaataaactagaaaatctagaagaaatggatacattcctcgacacatacaccctcccaagactaaaccaggaagaagttgaatctctgaatagaccaataagaggctctgaaattgaggcaataattaatagcttaccaaccaaaaaaagtccaggaccagatcgattcacagccaaattctaccgaggtacaaggaggagctggtaccattccttctgaaactattccaatcaatagaaaaagaggaaatcctccctaactcattttatgaggccagcaccatcctgataccaaagcctggcagagacataacaaataaagagaattttagaccaatatccctgatgaacatcgatgcaaaaatcctcagtaaaatactagcaaactgaatccagcagcacatcaaaaagctgatccaccatgatcaagtgggcttcatccctgggatgccaggctggttcaacatacgaaaatcaataaatgtaatccagcatataaacagaaccaatgacaaaaaccatattactatctcaatagatgcagaaaaggcctttgacaaaattcaacaactcttcatgctaaaaactatcaataaattaggtattgatgggacatatgtcaaaataataagaactatctatgacaaacccatagccaatatcatactgaatgggcaaaaactggaagcattccctttgaaaactggcacaagacagggatgccctctctcaccactcctattcaacatagtgttggaagttttggccagggctatcaggcagaagaaggaaataaagggtattcaggtagtcaaagatgaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatccacccataacagacaaacagagagccaaatcatgagtgaactcccattcacaattgcttcaaagagaataaaatacctaggaatccaacttacaagggatgtgaaggacctcttcaaggagaattacaaaccactgctcaatgaaataaaagacgatacaaacaaatggaagaacattccatgcttatgggtagaaagaatcaatattatgaaaatggccatactgccaaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactacaaggctacagtaaccaaaacagcatggtactgataccaaaacagagatatagaccaatggaacagaacagaggcctcagaaataatgctgcatatctacaaccatctgatctttgacaaacctgagaaaaacaagaaatggggaaaggattccctatttaataaatggtgctgggaaaactggctagccatatgtagaaagctgaaactggatcccttccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaaytaaagagsttmtgcacagcmaaagaaactaccatcagagtaaacaggcagcctacagaatgggagaaaatttttgcaatctattcatctgtcaaagggctaatatccagaatmtaacagtgaactcaaacaaatttacaagaaaaaaacaaacaaccccatcaaaaagtgggtgaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatattcccaaaggattataaatcatgctgctataaagacacatgcacacatatgtttattgtggcactattcacaatagcaaacacttgaaaacaagtgaaatgcccaacaatgatagactggattaagaaaatgtggcacatatacaccatggaatactatgcagccataaaaaatgatgagttcatgtcctttgtaaggacatggatgaagctggaaaccatcattctcagcaaactatcgcaaggacaaagaaccaaacaccacatgttctcactcataggtgggaattgaacaatgagaacacatggacacgggaaggggaacatcacacactggggcctgttgtggggtggtgggaggggggagggatagcattaggaggtatacctaatgttaaatgaggagttaatgggtgcagcacaccgacatggcacatgtatacatatgtaactaacctgcatgttgtgtacatgtaccctaaaacttaaattataataaaaaaattaaaatataaaagacctgcatgcattaggtgtttgtcctaatgctctgcctcccttttccccccatcccttgacaggccctgatgtgtaatgttcccctcgctgtgtccatgtgttctcattgttcaactcccacttatgagtgagaacatgcggtatttagttttctgttcctatgttagtttgctgcggatgattatacttaaatatttttaaacaaggctttagacctaaatccatcaaaataaaccactttgcatgaaaaaaaatcatgggaccatttcagcatgttctataggtgggctgatttaaatgatttccttatacatctctttctgcttgtgctattgaataattgagaagtttgcagggggtgtggtgccttgcacagaccgagaaggaagagaaaggaagcaacacttgcaaaaggactttgttgtgtacagtgatagaatgctctacctgtgttactcattgaatcaggaggattgttgaaggaggagggctctctggaattgtaatctgaagaatgagggttattcatcaggaaaagagggcaaggcaaggggagggggaagcataggagaagaaataaaaggcccagaattctgaaaaactccatgctaaaagacccagaattccgaaaaactccatgtcagcagggtcaaaataaattttgtggaatggttacttagattgagagaaggactaatgagaaatgaaactagaggtagagtcagagatcagttaatagtcttctattttaggttaaggaattcccatttcattctgaaggtcaaggacaacttaggtaaagggcagtgactaagaaagaccaccctggtcaggctcgatggctcacccctgtaatccaagcactttgggaggctgaggcaggcagatcacttgaggttagcagttagagaccagcctgaccaatatggtgaaaccctgtctctactaaaaatacaaaaattarctgggtgtggtggtgcaagcctgtaatcccagctgctctggaggctgaggcaggagaatcacttgaaccctggaggtggaggttgcagtgagccaagattgcatcattgcactgcagcctaggtgatagagtgagactctgtctcaaaaaaatagaaagatcattctggcttttgggtggagaatagactgtccatgggcaaagtcagagtccaggaggccatgccagaagctgctgctgtactttaggcaaattctatgtggtggtggcattggtagtaagagtggagaggaatatacaagttagcgatacatttaggaggtaggttcgataaaacttggtgatttattaagtttgaaagtgaagaagagggaggagtcaggattgacttacacatgaaacatataagacttctttctgtcctaaaaaaaaaaatcaccgttgtagaaaatgatagaaactgatggacataagaaagcaatcaggatctcgattctcaatgccatgtgaagaaccacatgctcttttgacattttaagtagagatgtacatttggtttctgcagatccatttcatagctcggctatgatttcagactcattactcaaaagcaagggtgtaggatcaggggagggtgaacaagttaggcagaggaatgagctgctctgtgaggtggtttgctccacagcctttcactccttcttcccaacgtctcacagtcataaaaaaaaaaaaaaaaaaaaaaaaaagtaggagggagtgcctatatccagtagaattggagacaagttagggacagagctcagagagctgctcctgatgcggaagtggcaagaaaagacgcttcacctccctgacaacaacacatccactgtgtgtagcaatacgtttctgcctaagacaatttacccccagggaaatacaagaagggagacatctcccaggaaattaccatttgtttctactactgaaggattttcgtctatttatttgagaaaagtgagaagcttctttttgctgagaacatagtaaatgctgcaaaagcatttgatgtcatgtccattaagtaacttggctgaatttcttgaagctttaggtaccttgcttcaattcctgcatactatttactgaccctctgtaacaggacttttcaactttcaactatattagaacatgtagtttctctattaccaagttccagctgaacagtctatctttaatattcagaaagtgtttggtgtctactagccaagactgtagtctgagcaatgacattgacagtggaccttgatcttccttcctttgaagcataagtgccttgtatcattttactttcctctagtagaagtccttcctatggttatagtatttagtttctactttttgcatttaatcggagcatctttgtaatttacaatttttaaatctttttttttcaaggactaaacacgaaggtttgaagtccaacaggcaactaaagatgtatacaaaccccgcacaaatcagcctccattctaatgccattcctcttctatacttccattttttaaacctgagcatatattttgttttgagtcttttcttactcttttatttgttaatactctttattcagtttttgtcaggtaaaaatgttttgccttgccaaagaaccatctaattccttctcaggtctttttaatatattgcttccagatatttttggattggtggtttctgcaattctccctaaaacaatcttcgtttctcttacacatctcattctctacgctttggcagacttttgcagatgcattctataactgcacaaattacccttccaattttctccagctaaacaatctaatccagggtcctaaatatttttggtgccatagactcctttggcattccagaggtgcccagggattttactcaggatagtgtctttaaatgcatgtttaaaatacatcagattacaaagaatgtcaattaaattgaaaaatagcttaaatattttaataattgtgatatagtaataaatgaacttctttaggtgcattaagtaacaagatctactaacagggctaataacttattatttcagtatgtctgtggtttctattggtgacaaaaatcacaagtactgttaatatttttgttttattttgtttaaaattatttaaattttaattaataaaacatatatatgtatatttatggtgtacagcacattgctatatgtatacattgtggcatggctgaatcaaagtaattaacatatgcattagctcacatagttattttttgtggtgagactgcttaaaattcactctcctagcaatttttgactgtgtgctgcattgtttttttaactatagttagcattttgtaaatagtcctcttagaattattcccccaattgaagttgtgtgccctttcaccaacatctctgcattttctccttccaccactctctgtcctgagtaaccaccattctattctctgcttctatgagttcaactttcttagattccacatgtaagtgagattatgtggtatttgtcttctgtgcttagcttctttcacttaatgtaatggtgctgttcatattactgtggttttggtgcctacattcaaactcagtggaaattctaatttgcagttagtttttcagaaagaagaaatgtgtgaatagtttcttatggtccaagcccttggatcctctgtattttatccacagatgcttgggaggatctctagatcccagattaagaactccagctagttattagtcctttgtgctttgaaactcaaatcaaatacccatctcttccatagaactttttctaaattcactagactcacttatctacccttcttcctatagtttcattcactctctgttatgaaatatccatttattatcactattagtttttctgtattgctctcttctttgtaaatatctctatactttattctcttttatttcctttgtatccaggacagtgtctggcatatgcaggcacacaataaatacttgtttaataagtgaattaaaactctagacagcttctggtaagtttttccaggttaccagtaatacaaagacctgaatgttatttattcacttctacaaggggcacagtgtccaagtcctgacctttaataagagatgtgcttccagcagtgtcttcttggcatagtcttaaccttttattctgccctggtgcacacttaatctctcatgaagtcacagctattgatttataactgaatcttcaagatattttaatactttataaacatacaaacaacaattaattgcattgttagataaaaatgtattacagagatcaccagcacaaaaataagtatttctatttataactgaaaaaaaaactggcaatggaatattagttgtttacaaggcaagtattctgaataatgtgctgggagattataaataaccttaactaacagtaaaaaaaattgtgcttacagaaaaaaattatttgagttagtctaaatgtattaaacttatcagtaagtagcatgaattaactactattcaagtgtaaaattctacttccatattacctaattcagttccatatgaagtcagccagcaaggatcagctgaggttggctgttgtgaggtttcagccattatgaaaaagaggagctgggcacagcctctgatgaataataacatggcatgggttctgataataagcacagagaatcagaaaggaaaaaacacagagaggagtatggagaactggaacctgtggaaaatgatacacaatttttttttttctacagagtctcgctctgtcacccaggttggaatacagtggtgggatctcggctcaccacaacctctgcctcctgggttcaagcaactctcctgcatcagcctcctgagtagctgggattacaggcatgcgccaccatacccagctaatttttgtatttttagtagagacagagtttcaccatgttggccaggctggtctccaactcctgacctcaggtgatatgcctgcctcagcctcccaaagtgctgggattagaggcataagccactgcacctggccccacaggcttcacagtcagtaggcccaaaggaagtctggtgtggtcgatcaagaatccagctaattctcgcactctcactgtctctctctttctctcaccttccactgacctctcttccctcctattttgtcttgggaaaaggcaggtgattacaaaattcttctaattatgtattttaattaatataaaatctttacaaaacagtgttaataccagcccactatggtttatattttttgctgtgaaaaaaaaatctcctatgctttagcaatactttttaggcagagagtcatcaaaataaaagagtatcagtattgctgaagtaggtcattcctgctttactttaaaaaatttcaaaacgtttcatttttcctccgtaaaatttatttctatcaaggaaatggggagagaaaaattacaatgaaaaactgtgaggataaatgaggtcatatgcctatgaaatatttggaaaagaattataattatcaacttgttcatttttaataccatagttagatttctcattttaaaaggggaaggaaagaactccattacattctagggattctaggcaagataagtttccatcacagttgctggatggtggagctgggctggtatgacattctttccttgtagaacgtgcgttctaactgaagactagccctttattagaaatgcacattgagaagacaggggatttatgagtcacaaaggccaagatttctaaccttgctacatgtggggcgggacttttctatgctcccaaggacttaaggtcaagtcactttcttcctgttcccgtctccttctgtcttcctctcttttttggttctaaccagaaaatgtattccaatttttcttttctttttctgttcaagtcttacagctctgccaaaggcaaaatgctgcagggattagaaagatgaagcagctaagtcaaatcgatagtgacagccagtgaacgcatgtaaatttcaacaagtgaacgttcagcattgtctctggggcctcccaccaatattaacatcactaaattttctgatttaacattctcacaaaacaggaatcaaccaaccaagtgccagccactaatagccttcaggttaataaatttggtcttcattaatctcaaattagagtcctggagtagacttatgtttgggataggagtgcccatcctacaagaagcttattacccataaatcaggtaagagataagaaaacactcctccaggtctcattagccacttcagataggctctgcagctctttaatgttcaggtggcatgtccttagaagatgagctgagaatcaaagctcctgatacaggaagaagcctaactcagcccatctctcttcttggggcattcacaattatttcctttaacccttgtgtagtttcagttgtgttgattcaagtcattattttcttacacaactagggtatatagtttagaatgtgatagaatcttggaaaaatagcaattccccattatgtatacacacaatacacatacacacacacagtactatatatgtatgtgtgtgtgtgtgtatatatagatcacgtaaatatatatgatatatatagatatatagagagagtacatgtacatatatgtgtataatatattcttcactttcattttatttgtctttatgatttcaggcagtggtataagaagatagaaatagcatatgagcacttcacacagtatctgctataaaagtttattttgacactttacttataactccttgaaagtgataaaattttcctattttcctgaaggtacatttagacaaaaatctcagagcctaatattttgaagtgttagttttgctgaggccaaacaaaatcaaggcccagcatataccccgaatacattctcacttaccataaatttattatgaaatggtattgtgttgataggagagtttttgttacagcctataacatttcagggattttgatagacatgatttccaatgggataacatttaaactgagatagctactatttttttttaatatatgtttagttttgtgaaaaaaaaaataaggaaagcatctggtgattgaacaaatatgtagtagagctaaagacattttccttaaaagaaatatacttgttttatgctttaatggttagagctgttccattatagtgtatcatctatactcttctgatttttattacaagtagggatacaacttaaagatttaaaagtccttcccaaagtataagcatgtgtttaattttcagaatggcagtgagacttacttgcacataaagttaagatacctaggttgtgggcttccaaggatacttccttgggaagtctttagaagttgtttttagttaaggacttggtagcatcaagggaagccatgagtggtgaaattctcagagagactcttctttctgtggtcctgccttgtagatgacattctggagacttttgtgtgtaaatgaatgattgaaattccatagtatatttgtcatttttcctaagcctgtttactctggggaaaatcttctttcatccttctaagttcttactccacactcccgtgggtgctcatgcatgtgtgcatgcgtacacacacaaacacacacaaatatgcatgcacacatcttcagtacttgaggcattaacctgcagaaccataacaccgtgaatatagcagtaaaggcaattatttctgtaaacaggtaacagggtgtattaatattactgttagtacctctgaattctttcttccttaataggatgtattaatattaccgttattacctctgaattctttcttccttcccatcatgctagagccatcttgaatatgacttaagaagtgatctttacattttgcctctgtctcaaactaggttctagtggctattaggggctagaccaaagctaaactgagaataaggttacgatagcacaattgttcataggtggtctctcaagacaacagcattgcaaaagaaggaataattgttatgtttattttacctatgggggaaaaacagtagtccgggcagtctaaatgatgtgtccaccatcatagaataatagagagtgaagctgtaagtataattccggttgactttgtatccagtaaaatgttcattcaacttttgttcatctctcctctagtcacactttgtcatgcattgacttcttggcctgatctcaccagtgaaaacccatgggaacagttaataattccatgactaaggctattataatcctatagctacagtttctccagtgaaataatgaaaatttcttcattaatttattataaaagttactgagtttaattgtatgccatcctggatttcttacagaagtgattcttgataatcctaagaaaattcttcttcagacagattttcaaaatgtttttgtctctgcaattactgttctgaggttagatcttatagaagttactccataagaagccaaagcattttcctcaaagtatagtggctaatggctatgctgttaccaaaagctgtgacagaaaacctctggctattaaactcatatctaatgctatttggcctagctattatgtacaatttgagaaactgatttttctcttctaaaatgaaacacaaggccgtgtgcggtggctcacgcctgtaatcccaacactttgggaggctgaggtgggtggtaatgaggtcaggggatcgagaccatcctggctaacacagtgaaaccccatttcactaaaaatacaaaaattagccaggcgtgatggtgggcccctgtagtccctgctactcaggaggctgaggcaggagaatggcgttaacccagctggcggagtttgcagtaagccgagatggcgccactgccctccagcctgggtgacagagcgagactccgtctcaaaaaaaaaaaaaaaagaaaaaagaaagaaaaagaaaaaaaaagaaagaaagaaatgattcgcattgtagggtcatgaatttcaacacatattacagttcagccccttctctgctgctggtggcacactggagatgtggagatgcagattctcaccacacaaagtggggtccgtcctggaagcttgtaagaaaagcagaatctcaggccctacctagaacctactgaattagaatctgtgttttaacaagatctcttggagattcagaggtacagtaaagtttgagaagcacagctggaaactgtctgaagtctgctatgatcatcttaatcttgggagctgacttagcacagtttctgcctctcccagcccagcctctctgccctatttaggctacttctggagagttccacagtcagaaccttagctatttctgtgcctggtctttaccacacacaggtccaaagatgcccaggaaagctaaatcatagacttccccctactgagcatgttgggctgcctgcagtctctccctttatcataggttggccctctttccacattgccatgcagctttgaatgactgaatgttcaaatttttcacagtgttttcattgcttaacaggacatccatggctgtaatttttcagtgaagcatagaatgtgttaattaaagtggcaatggaattgggacaggttgaatattaaatgtcacttctattgtgaataccatcatgctcttaacatttttattttgttttcatgaagacttagtaagggttaaaagtgggcgcattagtgagctggtatttgcctgcccaccaatgctgattttgatttccatggcgtagttctttggggtcagcatgcatggtgtgttaaatgttaccggggacctgaggaataggagagccctttccttatgacacttaatcctgaattatttatctaaataattaagggcaagcatttttaacttcgttaacctatagtttctgaataaaagagttattgagagctctgactcaaggacaaatgacaaaagatgatccctggagtcagggcatcaccctccataagtctcactggaggtttgcttcctgcacaaggagacatgtctgtgatttgtgaagcattcatcttgtttcacaagactttatgctgcacttaggctaaagtcactgccgaataagtcacttcactatcaagaaagaaggggatggcttttctgggggagcagaggcatattaaggtagaggaggggtggcgcaaagcagtccagccaagaaaaaaaaaaaatcttactaacaggcttagaattaccagcacatgttgatagcagaaagcagattggcttttagccagttttattcttgtttttaaatctctaaagacaacgtacccacttagtgcctgcacttggggcaacatgctcccactcccacctcctccttggtatgccagtgcagaggagtttgttcacacatttaagatattacataaaatacatctctgaaggtcgacactctcagggaagagcaagaaatgactggagcatcttagctgcaagataatgtcttattcagatatctttactctaggattatagattttttttttttttgagatgaagtctcactggatttcccaggctggagtgcaatggtgtgctcttggctcactgtaacctccacctcccaggttcaagctattctcctgcctcagcctcctcagccgctgggattacaggcattcaccaccatgtccagttaatttttgtattattagtagagacagggtttcaccatggtggccaggcttgtctcaaactcctgacctcaagtgatccacctgcctcagcctcccaaagagctgggattacaggcgtgaaccactacgcccagctggattatagattttgacactcagattactttggctggtctagtaggcaaataatgacaagacatgctcctgccaaagatgtccatggcctaatctccagaacctgtgagaatatgctacattgcatggcgaaggggaagggagactgcagatggaattaaaatagctaatcagcagataggaagatcatcctggtttatccatgtggacccaatgtattccaaggagtctttaaaagtggaagagggaggcagaagaagagagacagagtaagatgtgactaaggaagaatggttaaagaaatgtcgctggtatcagagacaagaggaggaggccgtgtgcttcctcttcatgtgggctatgcatattctcactcataggtgggacttgaacaatgagaacacatggacacaggaaggggaacatcacactctggggactgttgtggggtggggggaggaggagggatagcattaggagatatacctaatgctaaatgatgagttaatgggtgcagcacaccagcatggcacatgtatacatatgtaactaacctgcacattgtgcatatataccctaaaacttaaagtataataataataaaattaaaaaaaagtcaaggaagtgaattagaggtccctagaacctccaaaaagtaatgcaaccctggatggcatcttgatattagcctggggagacctgtgtcaaacttctatcctgtagaactgtaagataacctgtgtttttcttgtaaaagatttcaacatttgctttagattcagggggttacatgtacaggtttgttacatggcatcacctagatagtgagctagtacccagtaggtagttttcctgcttttgcccccttccgtcttccccctcagtagtccccagtgtctgttgttcccatctttatgttcatgtgtatccaatgtttagctcccacttataagtgagaacgtgtagtatttgattttctgtttctgtgttaatttgcttatcaacctgtgtttttaagcctttatggtaattacttatggagcaatagaaaactagcacaatagataaagtcaaaattggtatggtatgtagaacctaacagagcacggtcctggctccacatctgattagtaatgtgcaattggtaaatttctttagccttattatccttatctgtagaatggacataataatatttaccttatggggttaagagagaatgaaataagaaagcaactataaaatgtctgggataatgcctatcagggtggggctgcccaaagatactaaatttgattttatttctttcctcttatacaatttggtggccctcttagtgagtggccccatatcgttaaggcttactgctaactggcccccctgagtccttagaaatatcaccacatttattgatatttcactgtgttcctctgagaacctcatttggccatatagtcttctaccaatcactggagttttcattagtgctagattggcattagacacatggttatagaaggatctagtagattattattttgtaggagacatcatcagtgctcatgttaaatgaatgatacattctgttgaattataaactgcctctcctacacctttgtctttgtacatttcagtccttcttctctattcaaaactgacgaagtaaatcagttgggaagaatacagtaatttatttgaataaacatttgtcaacattgtttaggaaaataagttacaaattgactgtatcgtcatgttcctgcactaagaaagcattaggagtctgcctaaatccttttatcaaaatgtattattattattattattattattaatttttttctatttactctttcttttttaaaaaattgctctcctctagatattttttctgccactctttataataaaggagacaatatttctaactgcccaacagacttcaagatgatcttgacagcctctgtagccaaattatcatattaatttgatctcagcaacacttctggttcactctgttctgtactcaaatccaaatcctgagctttttcttgagcaaataaaggcaacagctgtgaggtcccagttcatctttccggttttacccatacaacaacaggctgtgcaaagttgtgagcaattcacacatagtgctctcaactctatttttattaagtactctgaagagcaagcaatcttcaaactcctataaaatttcatgaccaaaacagctatcgggatggtgtttcccttgaaatgtctctatgagtacagtcatttattattctaggcttcctgataatccttattagtggataccagaactgtgattttaccgtatttgcaacctaatgagtaagtctaccacatgaatgctggcagaagatacaagattcctgggtcagagatgaaggatagtttattgctacaggatagcagaataccagcatttatgccagtccctaaaatttaagtcccatggggcaaagggaagagggccagacaatgcctgcagatgtaataggggagagttgagtttagggtacccccaaattttataataggcagtactttggtccagataaagacatgttttttatactggatagtagacaaacatccatttgctccagttggagacaatacttctgtcttcccatagatgttcactgtgcaaacaattcttgaaacaattgcctggaacaaagttatcagttattagattttttttttttttgagttggagtctcactctgtcacccaggctaaagtgcagtggcatgatctcagctcactgcaacctctggctcatggattcaagagattcttctgcctcagcctcctgagtagttgggattacaggcacccaccaccatgcctggctagtttttgtatttttagcagggacagggtttcaccatgttggccaggctcgaactcctaacctcaagtgattctcctgccttggcctcccaaagtgctgggattacaggcatgagccaccacacctggcccaaagttattagatcttctgttcacaagatacacagaaatgtgagaggccataacaagttgtcaccctacaatgagtttcttagatgtaaatcgactcttcccttcctatgttggtaagaattgtgccatatgaaacatcatcataggcatatgtaatgttaagcttttttgccgtaagagaaaatttttccttgcttccttagcagaatacaggcttcagttatgtgatcaacctgtttggatctgctaggttaaactataaatgcatttttaaaaatactacagatatttcactggacaggaaatggggatggggaagacagaggagagagtgtatggcctggtaacaaagcattaccctttctgttgcacactgctgcccattttaatgttggccagcagccaggacaaagagccaaggcagctccaaaggatctcagagttggaggcaagagagagtcaaggaagctcccacatgctgaaatgtcaaacctaagcagacctggcctcagagtacaacacaatcagatcttccaccatcagagtcattgatagccacactggctcccttgctgtttctggagcacagcagacatggacccacttcaggtcctttctgctggctctggtctgtcataggtacactccttcacctgatcacccagggatcgctttcttatttccttcaagccttcttcatccaagtactgaccaggcctcacactgcttagcttccgagatcagctgagatcaagcacgttcagggtgataaattagttcaatcactgtggaaagtagtttggtgatttctcaaagaacttaacacagaacaagcattcaacctagcagtctcattactgggtatatatccaaaaaagcacagattgttctaccaaaaagatacatgcactcacatgctcatcatagcactattcactataacaaagacatgaaatccacctagatgcccatcaacagtggataggtatacatatgatacgtatacaccatgtaatactacgcagccatacaaaaggtatgaaatcatgtcctttgcagcaacatgaatgtagttaggggccattgtcctaagtaaatcaatgtaggaagagaaaaccgtatgccacgtgttctcacttttaagtgggcacaaaacattgggtacccatggacgtaaagatgggaacaatagacactggggactactagatgcaggaaggtgggaggggtgaaaaagctaactattgggtaccatgctcggtagttgggtaatgggattatttgtatcccaaacctaagcatcacataacataaccaagtagcaaccctgcacatgtaccaatgaatctagaattaaacttgaaaaaaataagtaagtaaaacataaaacatatagatttttaaaaggcatcttcaaatgtcaccttgtagtgccccaccctgaattgtagtcacctacacacataaactcacacacaaacacacactcccatacacacatcaaaacattcaatacacctaccttactctatttttttttctgacttccaacatagtacatcatttatttaacaagaacgtaagctcaacggggaggaattgttctctgtttattttctgatgtttcctaggtacctagatcagtgcctggtgcatatataaatgaatattttgagtgaatatttgtggaatcatgaatgaatgaactgatgaatgttaatattggtatttttcattgttatttgtcttattcctaggaagacaggactagtcatttgaggtactttttcagaacagccagggctggggaggatcctttatttgtgggtgttaaataatagcaagtgaacacagtgcagcagtagtgaccctgttgatgatgataatgaatcacattgatatagtgcttttctttttctacctttgtgtgtgtgtgtgtgtgtgtgtgtgtaattctcctcagtgtcagggtgatagattatgcccattccttctaggaaaatggttattccatcttaatgcaggcttttagaaatgaaaaataatgcctgctacaatcaacttttaattatctacactaatggagtgctgatgctaaagaaataatccccaagtcatttacatttgactttaggatgcaaccgagggcttgtattcagaaaagcacgttaaaccatcgtcagcagcatgtgattgcagaacaaattctggcctgggagttgggaaactggatttggtagaggctcggtgttatgggttgaattgtgatgccgcccccctgccaaaaagatacgttagaatcccagcccccggtaactcagaatagaaccttatttggaggtagtgtcttgacaaaggtaattaagttaaaatgaagttgtttgggtggaatctaatccaatatgactggtatttttatagaaaggggaaatttagactgagacagagacatgcatacagggaagaatgccatgtgatgcctggaattatgctgccacaagccaaggagctactgcaagttagcaggaaggcctgggacaggcccttctctagcacctgcagaggaagcagccctgtggacaccttgatctcaaacttccagggcagtaagacaaccatgtctgtggtttaagctaccccattcatgggactttgttatgacagcccttggaattgaatatgcttggtgactcaactcttatgtgctcatctagcatacagttccctctcatctccaagcctccgtttcctcatccctaaaatagaatccaaagcccctagctgtttaagggctctataattagaaagcttctgacagaaagtccccatcagctcctcccagtttagcagtaaacccatccacctaggtgtcctctaaattaggtaagtgaccctagaagaaagttccacacatcatctgaaccgcggataaaatgcatgcagaaatgactttattcaaattcaagagtttacattttacttaactctggaaaactcagagtttaaacattttcacatttttttttaaatagcaagaatggcatgccacatcatgatgattcagctctcatctctatttctctaggcagaatgcatttacacatcatccaatcccaccctatttccatgtactattagcagaagcaaatatcagccttcttcaggccctggcaggataaaaattcagcccagtagacactgggaggacaagaatgaggatgtgacttacattccccagggccatggcattcaaaaccaccatacccactgaatgtgcttctctatcgctttgtttaatatttggagagtagtgtttgctccaaaacttgtaaaaagtgagaccaatggaaaccattggtccaaagcaatcttacctgagaaacattttaaaaagaagtctttcccttatgattcctcttcttactctacttttttgaataaagagattaatacccaaccgatgactactgcaaggatgaaggttattctttaggagaaaaaaaaattgtaacatacatttttatgaaaaaaagatttctaaatatgctgataaaatcactgacatctcagtaaatatagtttattcctaggaagtgactagaatgattgatttagctatatgtaagttatttaatactgtttgaaaggtacttcatcaacaccatttactgtgatcaatagcattttcaggaacacttcagacttggggaggttactcctttgggtaaccttttaggattatctgttgtgggaacaagaagtagccatcaaaagccactgagcaggctgggtgctataatcccagcattttgggaggctgaagtgggaggactgcttgaacccaggggtttgagaccagcctggacaacatggtgagatcccctatctacaaaaactatattaaaaaaatttagcttgttgtagtgtacacacctattgtcccagttgctcaggaggctggggtgggagaatcacttgaccccaggaggtcaaggctgcagttagcattgcttgtgccactgcagtccagcctaggtgaaagagtgagaccctgtctcaaaaaaaaaaaaaaaatgtccctctaagcagttaaaataggtcaacatcaaagctcatggttctggctcttagtcaaagcctatttatatctgacataattctcatatattgcatatattgacctgtttggtttactaatccacattagaggccaacagtatagaaccagaatcagaaaatctattaaaaggaaatgaaagaataaaaaagcatggcaatatcaggccattaggtgtgggtacaaataatctcccaaaccacagtagtctctgagtgtttcactgacaaagtttagttatcgataattataattatgaccttgaaatcctagcgtagacattgaatactatgtttggaagtcagggaattgtttaatatatttaagaaagatattcccttcaaagcagttcaagtggtcttagtattgccagttaaggaagtgggttacaggatcctggaatgactcagtgatatagaaaggctcagtccctggcaatgtcagatgagtgaagaggttgatgcaaaagtaattgtgatttttgccattacttttaaatgtaaagtacaggcactaacatagtattagttactaatagtattagttatttagtaaattacttttgtactaacctaatactatgttagtgcctgtacaaataatgtgcagtaaaaacaatgagtgtgtgtgtgtgtgtgtgtgtgtgtgtgtgtgtattggaaagcagttgatctgtacacatacttacagtttactaaacaaatgtttgagtgcctactgtgtgtcttgctttggctgtgctctagacagtcatgataacagagatccctggtctggggaggtcccactctcagagcaattacggaagaagggtagaggaaatcatgcaagtatgtagggataggctgatgagagcggaagcatgagggctgagagctgcaggctgtcttcccactagtcagggaaggctttctgattaaagaaaattttcatcacctatgcttagaagtttagactcagaataactgatggcaaatggaaaagatgaaataaactaggatgagaagacaagactgcccaattcacacaatgaatccagtctctgaatcagtcgggtgctagccaaagcagaaatatttccagcagagccctgggaacagagaaggaggcagtttttattaaagtcttagtttccaaatgatggatgccaacaagaaaatagtttaaaattccaagagaagccttcacctttcattccattgtagagtaatggctttttcaaacacattcaaataaagccagggttgttaagtagtatgtctcaatcaacatactcaaagtctgtgaaccaaaggcatagtcttaggcttcctcttatagtctagcatgatattattctatttcatctttttttatatgtttgctcccttgagtgttttagaatgagactgctagattttatgtttctaaagctggttttctaccaggcctgttytcagaacattctttttttttttttttttttttttttttttttttwaagatagagtcttactctgtcacccargctggagtgcagtggcgcgatcttggctcactgcaaccttcgcctcccgggttcaaacgattctcctgcctcagcctcctgagtagctggaattacaggcgcccaccactaaccccatctaatttttgtattttttagtacaaaatgggatttcgccataatggccaggctggtctcaaacacctgacctcaggtgatctgcccgcctcggcctcccaaagtgctgggattacaagcatgagccaccacgcccagcctagaacattctttcttggaaaggaagaacatcacagccttctgtgcattctcttgttcacccacataggcaaggtgatgtgtttgcagccttctttttaccctcacctctgggaggtggccttggctcatcacctattgtttcatgctctctcttaaaggctgatttggtgactgaattcatcattgctgcctacacacccatggggctagcctgggcaaaatgtgcctcgtaggttgcctgaccttttgccttttggcaacgtttatcacctctgaggattcagcttctttcgtcagaaagtgagaacttggatcaggtcatctctaaggttcctttcagttttaacctttcagaagtcacacaaccataaacatttggtgtacctagactgttggcttattgtccgactttaagccagtcatttcagttaaacaaacaaaaatgggggcttgccagagtcaagtcatacaagactgctttcctaatatttggtgcttcttaaatgaagttgttatttatgcatccctcaatcccctccctcttctgcatattttgaacttgcaaagccttctgatattttaagcagaaggttgcaaatgcttgtcctactgcctggccaagtcttaggtaaaaattgtcacctaaccacatcctcagatcatttcccctgtactctagatcactaagcgcatgtgcacacacacgcatgcacgcgcrcacacacacacacacaccatccaggatcctcctgaggatgaatgaatattcctgggccaaatattgcatgaggatttgggcaatgttttggctagttgaacaacaacaatgctcatatttatgccaattggcaggaccattgcttgatcatcctgtacttggtgaagggcattttttattgtttccttttttgtttgtttgtttgtttgttttgtgaggcagaatatcaccctgtcccacagactggagtacaatggcatgatcttggctcactgcaacctctgcctcctgggtcctagcaattctcctgcctcagcctctcgagtagctgggattacaggtgcccaccaccacatcgggctaatttttgtatttttagttgagacagggtttcgccatgttggtcaggctggtctcgaactcctgacctcaggtaatccacctgcctcggcctcccaaagtgctgggattacaggtgtgagccaccatgcctggcccaagggcattgttttctaatccagataactaagctatccttagggtgatatgtaatgcagcaattgctagaaaatgacatgttttcataatggatctttctccaccatctagaaatttaggtaaagttgaaagaaaggataggaggaaccatttactgtgcacctactttcttcctgagattttatacatgtcatttgatgtttacaccaagtttttgaggtcaatctcatatccaaagctctaatcaattaactttaaattagttaatgacagggctctcttattcttaaacctgtcatttcccctaaactatgttgttttcctaaagtgagattaaaagtttgaaaacaaaggaacaaaatgttcatttatttactacgtttctgaaaacttgcatatatcttaatatatatatatatcttatttatatgtcttatttcattgttatgaaaacckagctttctttccttctatcctttcaatattatgctacttgtatttagtatttacattgtatgattcaaaatattgttcactgcagagccaagtagtagactatgaccgctctgcttattttgaacaatcttttatttttttctggagttgataattgcttcagatttttgtctggctttttataagcctgttgataatttcctgtttattctaatgtctgtcatatgcctatccatggagttaacctagtttcattttgtttttcatggccacatctttatcctcctttctgtgggggccctcagcttctgctttaattccagctagatactttctgctttcattcccgctatatactctaattccagctagatactttctgctttcattcctgctatatactttaattccagctagatactttctatgtgggctgcaaaggtgtagccctgatacttttctcatctatcatcctgagacttcatcttacaattaccctgttttccaaatctcatgccttctacttccttcctttactctccatttagaatatttttcagcagcttctaaattagcctacataagacataaactcttagatcttacttgtctgaaatgtctttcacatatgattggtatttgagctaaacataaattagagattgaaagtcatttctcttcagaattttgaagacttctctactctttttctttctgctgttgtttttgagaagtccaataacatatttctaatcctttgtattttgtttcctctctgaaaactacttagatattcttttattacaaatattctaaaatttagtaatttttaaaattctctcattgttttaaactttttttttgagtggagtttcactctttttgcccatgctggagtgcaatgacacgatcttagttcactgcaacctccgcctcctgggttcatgtgattctactgcctcagcctcctgagtagctgggattacaggtgcgcaccatcatgcccaactaattttgtattttttgtagakacaggatttcaccatgttggccaggctggtctcaaactcctgacctcagatgatctgcccgtctcagcctcccaaagggctgggattacaggcattagccactgcacccggcctgttttaaacatttaatggactcaccagggaattttcttgtcttattactttgataatttcctccactccattttccctctaatatttttactttcggggattcctatgagtttgacattggttcttctggactaatgtttcctctagtgttttttgaagatgtctttttggattaaattctagaaaccgcctcaactttatatttcattgttgctcttgatggttttaatgcagatactgaatttccaagagtgctttagttgttctcttagtgttcatttcatagagcacgttgttctcctttaagaggtcatatcttctctttaacttccaggatttttttaaccgttttgtctgttctttatattatgttacttttctctcatttgctccacttcctccccaccccacccctgtttatttagatctcttcctttcatagtgaaggttcttctcaattcactagctacctcaactgtccctttgtatttgagaacaaggcattgagaagcattattttggaagctctgtgtgcatgaccaggacttgtcaaagactggagcttatcacaaggggatcagatagaaagctgtcttttctataagaggcattcccaatgttagtgtctgcaggccttctagaactggaagcagaaagtccctcctcggcatgtagagtctcactcattcccgtttgcattccatcacctccctgccctgagccctttgcacttgtggtacatgttgtttgaagtatgatgcttcattgattagattccttcaggggtaaaatctccattctcgtgtggggaaggtgatactttaagtcacctggctgtgcagcaacagagagggaccaggtagtctaataacaccttatgcagacttccaactcttgtttctcactataccttattctataaacttctggggaaacggctttctttgaattctgagcctttcttaggtatatttcaggccaacttacttgtaccttgtccatacacttgtcaactggcacccaagttcaggcagtctccattttaatcaatcagctgctgctcatccacctttcattttatcttccaaaatattgttataattcttatgcattggttagcttcttttctttaactttgtccttgtggattactactcattttggtcttttattgttactttagtggcatttcaggaggaaatggaatggaagtgtgaggtcaatgcagcatatcaaccagaatctagcctgaattgcaactgtctcacaataggtgccggactctgcagttatggttctagatagtacaaaatttcctctctcttatgagaaatatgaaatcatttaaagcagttaccttttctaaacaattccatggactctgagtcaaaataatttggcaatcatttattccaacctctcctggatgcctaaactatatccctaagaggtgattttacaatcttgaattgaatctctccagtgataaggaatttacttacacatgaaatgattcattacattttcaagtcatgttgtggtaagagttagagtgcttctaagtatctttgttaactcctaaaatctgagtcttacaaataactgacttatcaagttgtaaaaagtaaagagaaaatccccatttctcctactttaaatagaccgtagaaaataatgatgtccaaatttgtcaaatacgtcaaactcaactgcatataggaccattggtgtacttataatccaagaagtgccaacacaaccatatggcatcagttgaagggacctcaagaagttaatgtggatttcacagtggcaaggctgatggctttagtcttgctgaaagttctgcttgtttgatgagaaatatttatataatattttcagaggcttatttcttgtatgtaaactctcagatgtgaaagggaattcatttgctgcatattgattagctcgttgagtgttaatttctcatggttgtggtctgcatgagagaactacaatcagctagagtcaaagaaaagtggatgcttccaccagctgatttttattttatttttatttataatatggaacactactgtaaaagaatctttgcctgtctttccactttataattataaagaaaaggaaaaaaagaggttagagggcccttcaaggtactttaaaatgtttttttcttagcaattcaaaatgtcctagtgaaacgggagagttccctgactcccttcacaggacttgtgacaggggtgtcttgtttatttggcctcagtgctcaaaccccttatgggatggggaacatgcaggtgcacaggagcagaagccagggtgagtgcttttgggctccagccccacagtggtgtctaggggtgttacaatgctcttttagccctgccatctggagatggcttaagtgttaaacagctcagtgaaaagtcagtgtgacagccttttggggttcccatacccagtgtgtcctgaattcttgttcagtgtccatgaagaatgaggtcatacagacctgaaggctggtgaatgtggggattttgttgagtgatggaggtggctctcagcaggaaggggaacgggagaggggacggagtgggaagatgatcttcccctgtagttcatcggtcccgtagctgatttcctctctgtccacagctaaactcctcttgaccttcagacacttcctctcttccctcctctgctgcactgctctgctgctctgccactcttctgcttgtggagcctggatattggggtttatatggatgggcacacgatagggggttgcagtgggtcaaaaggcaacatttgggtgcaaaaacaggaatgcctgttctcacttagggctgcaggtctacgcttgagggtggaaccctcgccaggaactcttttgcctcctgtccatatcactaggaagaccattgatgtgtttgatctttgtaaaactacatatgactctcaagttgcaagtgatactgtggttcagcttatcaaatactggaatttggcttctgtcactgactctgccactggctttgtggtcctgaacgcagccctgatgtcagatgtgttggtaatcttggggaactttaagcaagccagctttttttttttttttttttttttttaggactagatggaggtaagggaaagtgtgagacaataaaactggcaaccagaaacagaagaagaaaggaagagagaaaggaatctacggagtgtggaagttttaggagtaaatttctatataagttgcaaaattttagtaattctttagttcttatttcatttattcacttattttttttttcttttkagacagagcctcactttgtctggagtgcagtggtgcaatcttggctcatgcaacctctgtctcccagcttcaagcagttctcctgcctcagcctccccagtagctgggactacaggcaccagctaactttttttatttttagtagagatgggatttcaccgggttggccaggctggtctcgaactcctgacctcaagtgatccaccttccttgtcttcccaaagtgctgagattatagacgtgagccaccacacccagcctcattcattcatttattcattcaacaagtattaattgtgtgcctactataggccaagtgtattttgggccaagtgcatttctatgagctaaggatatagcagggaataaaacagttacctccatcctcatggcacttacattcatgtacctgcaatccccatcagaatcagcaactaggaagagatgatatcagagcttgaacgtggatccagtaatacccatggatagttctgtggaagtaccacagagaaaaattcaaaggaaagaggaataggatatattgagatacaaaaagtgtagcaatggaaaatcaggtgatcagattattgagaatgaaatatctttagtaaagatttgaaggagttgagtagagatatctcctagatatctacacctacatagaagatcatgccaagaggaggagcagcatgttcaaaggagagaatgggtatgacatgtttgaagaatagtcagtagtttggtatggctacagctgactcagtgagatgggaatgaggtcagaaagatgaggaaagggcagtccagattgtgttgggctttgcttgcaaaaacttcagctcttacttggtataagacagcaaaccattgaaagagtttgtgtagaggagtgacatgatctgacttcttttttaacaagatggctcttattgtatcattaacagcatggttttacatgaacctatcgttttgtttagtttgtgggtcaggactgaacaatgaaagtagaagcagtcctgtgacagtggcactaattacatttattgtcatagagaaagctcatgccagtcacatactagtcagaggagttttcagtcctaattgccacagaacaaatgactttggatgttaaatggactatagtcccctcatttgcaaagtggggatagtagtatctatatagtgaattatgagaagtaaatgagaaataacatttgtgaaaatgtctgacaaaatgcctgaggtgttaacggatcttttaaaatgttaactgtagcctcaatggattgtaagaatatacacatttaaacccattgacataaattatggctagaatgaaagttttgatcatcttgatgatagtttttgtcttttgggtttctttcttgtgtgttctatctgaagaaaatcatctgaaatccctcatttagaaattgaaatattttatgtcagcaagcacatatgttaatgatttcctgaatcagaaatgtgttcaaaatcatatctatagcaatgatcaccacagcggtagttctattagggaaaatacacgaaaacaaatataaaacaataacaaattaagtaactaattaaataatgtgtggcatggaaataaatgaaatactgtgcaaccttcgaacaccattttatagaacaaataatcattggagaagtagacgtgatatgttgttaagtaaacatatcatataaatggcttagaggcttagagatgtrtaggaaaggaaatactctaaaatgttaacaagaatggtatctctggtgcaattaaaagtctttttaatttggatgggtttttttatattttacaaatatttctgcattgattctacattacttatgtaatcaaaggtgcccaatacgtgttacttaaagaatctcttcaataattagaacgtaggcactcaatgctcatttttttccccagtgattctctgaacgtgtgttactaccatccaggagcagaactatatcttgctgagacatttgtgataatgacaaaacgtttcaatcagaaatttgagataaggatatataaatgattttttctcatgagaaataaaacgcaggtgtgttcaccaaaatcctgctcttttactcaatccccttggccaaaagtaagcacgacctctctggcattgtgaacaaaaagaggaattaactcaaaaagactaattttatgcattagatgatcctttagaataatcaagcatatgagtattagggtaacttatcctttttacttttcctgagggaggtaagagtagcaccgacttgctactgctaaagatatggactattggcctgggagggtaagcattttctgtctgatttaattaagaccactacctgctgacaaggctttgagaaagaaacaaaaataaggaatgcacaaataaaatgtaatgcaggtcaggcatggtggctgatgcctaagtgggaggcttaggcaggtaatcacttgaggccagaagtttgagaccaggctgggcagcacaccaagaccatctctctacaaaaaaaaaaaaaaaaatacaaattagccatgtgtggtgatggatgtctgttgtccagctagtcaggaggctgaggtgggagaatcccttgaggccagttcaaggttacaatgagctatgatcatgccactgcactccagcctgaacaacagaatgagaccctgtctcattcaattctttaaaaatctaatgcaaaaacattagaactgaaactagaaccagttttattggaagatgatggaaaagcaccttgtgatttatctcttttggtagcagagagctcatgatcgtccatctaactcccacaccatcttggagagccacagggtatcctacattatcctgctgaagatccttcagtacctaatggctctcgtgaagcattccaaagtgaaagtcatggagcctatgccactaaatcagatataactagatacatgttggattaaaaggaaaggaggaaaggcatakaagggaaaaacagagattattggagaccaaatacctctataaattctcaaaatttgtttaaaggctttactttttcaagatgcatattttggcaatagcttacgaagactgaagttttcttatttaatcttagagatactaatacttagaaaagaaaagtcttctatcttgttgaccttctctgtagccatttgaaatcttcattatcagaataatgcccctccatgtccacaattattaatttttatagatttagggggtacaagtgcagtttcattacatggatgtattgtgtaatggtgaagtctcggctttttgtgtagccatcacctgaatatagtgtacattgtacgcattaagtaattcctcatccctttcccacaacctccacccttctgagtctccagtgtctataattccactttctgtgtccacgtgtacacgttatttagcagccacttataagtgagaacatgcagtatttgactttctgtttctgagttattcatgaccagaattattattctaattattgtgaaataaaaattatgcctgactaaaatgactgaatccagaacttcaccataatccatctatctcctccgtgagtcagtgcatattacctattccaatgacctcttcagtactgtaaatattactgtgttccttttatttacttaataaatagatgtcaaatgtgtggaaaacaacatttgttttttcaaatacatgtttataacaccctttggaggaagtaagcctctagaacatgacagtctctggggtatgctattttcaggtaattttaaatgtcgctttccaacaaaaatgcaatactattatctttttttttaatgacaaagaaaagcaaaacaagtattatattggtgcaaaagtaatgcagtttctgccatttctcttaatgccattactcgtaagggcagaaatgaccattacttttgcatcaacctaatacctccagattttagatatttgagtgccattgcttgatatatcttttgttttttcttctggaaattttggttactttagttgcataaaggatgacttccattwtaccctgttaagcatctctgtctggtcagaagctactactctgttctttctagttcagtagggaacaatcagtttccttctcaattttcagctaatctttatgaatgaaatttgattaaatctagcaaaactatgcaaacatcataacagcatatggggagccttcctgtagtaccagtgggctatttccgtctaataacagattcaaaaaatccaattagacagtttgaaaaaagaaagccagagttaaaaatatctgactgtttgactgagaacagcagggaatggtttataggccaatcatttatggtgaataggatcttagtggtgagcaactcacatctctagcccattagaataatktgttactcatattgctcctaaagctttctacttaattataccaagttaaatagcagacattctcactcccttttgatggaaaatcacatttattcacccacacaataccatccttgggtgttaagggatgagagttgacctaatgggaagacaaacaaatggtttaggaaatgagacatgatttttttacacaaaggttaatgcacgagaaaagaaatgcctaggtctctgtctaatgtctatgtgttctcatcgaataattcttaaatgaccctatttagtttgattttctaactacattagaaatatatgaaacaattaagaaatcattttttacctgtcatatggcagatggactaacattgatcagggcagtcgaggaggttgtaaggaaatgggtactctcaaacattgctggtgggactatgaagtgttttaattttttttttttttttagacggaggtttgctcttgttgtccaggctggagtgaaatggcgtgatctcggctcactgcatcctctgcctcagcctcccgagtagctggaattacaggcaccctccaccatgcccagctaatttttgtattttcagtagagacagggtttcaccatgttggccaggctggtcttaaactcctaacctcaggtgatccgcccacgtcggcctcccaaagtgctgggattacaggcgtgaaccaccgggcccagccaagtgttttaatttttaaaaactatttgaccatatgaaaatatagatgttccattaaatatatatagcctaagaaatataatcagcaatgcagtaaaagattatgtrtacggatgctcctgacagttggatttacaatagggaaaagctggaaacaacctaaatatttgaaaaaagagaatggtaaatacatcaaaaatacaataaatacagtgttaagtgaaaagtttgtgcaattttgacttgagaaatttttaatgtactatgactacttggaagaatatggatgtacctcaaaataagtaatgatctatatgaaagactgtttttgataatttttgttttcttatacataccttccaatattgtccaaattttcaataataagcatgcatagcctaatatatcatgtagatgagtgcaaaatgaacacagagattaagatcatgggcttttcaatgaaggtctgagtttgaatcctgtctctgccatttactagcaatataatttcaggaaataacttaacatctctgctcttcagtttcctcatctgaaatataaggataataatggtatctgtgccttaaggatgaccaaagttatagatatcttaagaatgaattaaatgcgtttctctccatggactattttaacaatgaatgcctgacatagcaattatgttccataatcaccattatttatttataaaattatttagtattatttaatactaacattctggttttataaaaccaaattttaaaaatagataagtaaatgaaaggacaaggaaaacctaatttcactgtttttctagctttttttattgctataacttttatatcataaatccacccatttgaagtgtatagctccattttactatactgttttcatttataaaagccttttataaatttatacatacctttcagtgttgtttgaattttccatagcaagcattcatagcatagtatatcatgtagcagggtttaaaataagcatagaagagggtttcgccaaaagattatttaagaaaatctactaaaagagggttcttctgaaaaataaaatgtatttgcttttatcaaatgagcaaacttcatccacttggagatcacccacatgtgaatttctttctttctttctctctttcccttccttccttccttccttccttccttccttccttccttccttccttccttccttccttccttcttactttctttctctgatggtaagttacattagaggacaggaaggctcagtgatcagttttgatgggatggctgcacagaggcacatggagaagaagcaaggaagccaccttcagcttctgggtctctttgttatacaggaaaggaagtcaactggggtaaacctgtttggaaaggattgagtccttctctcaattttgaagggatgattttttagttcttcagatttatcttctgtaaataaatttcttcagaagcttcctgcaatatgataaacacaaatgattaggaagtgttttgtaaggattggggactaaagaaattattgatgaagccagaatgtgtcaaaaaggtgtcgtaaagcagcaatacttaaacattttggtctcagagtccctttacaatccaggacccaaagaggtttttttgtgtttgttttttgtttttttctaaaatgggttatacctatcatttttttcatattagaaattaaaactgagaaatgtttgaacacaggaatacccaagtacatattccagtgatcagcagagcaatggcatcatcacatcatattgcctccagaaaatcccactgacaatttgttgaagactaaaagggaaaaagccaaacaccttagtatgctgtaaaaayagctttcatctcacagacctcccgaaagggtcttgaagatccatgagcaatccctggaccacactttgagaaccgcttttgtaacgtgtgaccttcccttatcctctgccatgcraaactatctcagaatctaagattgtctacagccacggtacaaccagctctgagactttgaagagaagaaaagatgaacttcatcactaaaaaagccaaagtagttgaaagcaaacactagcygaattttcttcctccaagcctacagaccacctcacgtagtagctgtagtgggagctgctcccaagatttgataagaattagtaaagaggtttataagaccgtgtgtgcagagtctcacagttgctgatacttgttgggcttagctttatctctgtctacagtagcagcccaggacaaaacattcatatgatattctctctttcttctttaaccatagataaatgtcccaagaaaagggaagagaaacagaaaaatcatacatgctaaacaccagtttattaaatatatttgttgctgtttttcttttttacttggttgctcacaatattaatacaccctctttataaaacatgaaagcaatacaaaagtataatgagtaaaatgagaatcctaaaatgttttcttccataatcctctctctaatcgcatttctcagagataactgtgttagcattttggtgtgtttcttatagccctttttgttgtcaaaaataagcaaagataaaggggaaagattttgttctgtttcttttttctatatacacagtatatcttggagatagtttcaagtgccaaatacatgcatttatttttttcacagaatgcaagtcatgtcatagcatggaygaagttgggtttatttaatcattcactagttggcaggtatttaggttgtttacagtttttccattttagaaacagtgttcccatgtaaagaatgtcccttgtgcataaatcgttgtgacatgtgttggaatctcaaaagtggaattgctgagccaggggcatcctcattttaaaatttaatagacatcatcattatcctctagcatgcacatcactttacacaactgatggtaatttatgaggaattctatgtcccctcactccaacactgcatctagtcactctttgaaaattgtccagtctaatgggtgaattatggcatcttgctttgttatgcatttctgtgattaccagtgaacttgaacatctttccatatttttatttatgtttaacatcgaaacacgttacgttttgaatattttcctctactctattactgccttttatccttgattatagtttcttccatcacacagcaggcttgaatttttgtgtacttaaatttgccaatcttttcatttctggttcctgagtttttttgtttaacttaggaaccacctcctcccatactatctccaaggatagaaaaatactgttttctcctagagcttttgtgaactttattttttacaattatatctttagtccattgatggctgtgccttttaaataatgaaaagtccatatttaagttatttttttcccaaatagataaacatttgccttacaggatttagtaagcattttatcctttcttcctacatttgaattgccacctttaacacagggatattaggtaacttaagaggtaaatgtgtgtttcttgaatcccagatctaccacttaaaaattatgtaaggtttgatttactgattcatttttcctgccccaccaacttcatgaccataaaataggggcaggggagaaggaaatgataagacttagcatattataccatatggaaattaartaatacacataaaatacttaaaatagygtcaggcaatttaagagcactcagtaaagttagctcttattaaatttttgcaactccatgtatacctgggatctgtttctggtttgttcatggcagcattgtcaactaaaactttctgtgctattcagtgtgatagttattggacacaatgaccactgaaaacatggctagaatgatgggaaaattaaaattttaattaattttaatttaaagataaacagccacatgtggtcagtargtaccatattggacaggagaatgcccatatagtattttccatgagctttcatgagttatgctttattatataaaccagattttatttaagaactcatatggactagattatgaattttatgagatgattttccttgagtcatcaagaagaacacagtttttttctttaatctgttaaagttgggaagtattaatataaatctagttcctacttgaaatcaacattccagcaataaaccttattggttcttgttattctttgacctcacggttaaatttgatttgctaattttggttagagctcttctatattcatatttgagattattttaaatttgcattgtgcattgactgtgagatgagtattttgttggcttggtaaaatgaattaggagacttcatrttctaaattctgaaatagtttgaatattggagttattatctgttcttgggagatggtttttatcaccagttcccctaaactcctttttaccttgaggtaaagcaaagtctaccttactatttcttgtatggtgattggctattcaggttttctatctattattaagacaattttgaactcactggtgctccaaagaaaatctgaatcattctattacaaagatacaggctcacatatgttcactgcagcactcttcacaatagcaaagacatggaatttacccaaatacccatcattgatagactggataaagaaaatgtggtacatatacaccatggaatactatgcagccataaaaaggaagaagatcatatcctttgcagggacatggatggagctagaagctattatcctcagcaaactaacacaggaacagaaaaccaaacaccacatgttcttacttataaatgggggctgaaaaatgagagcacatggacacaggagggtaacaacacacactggggcctgtcggggagcatgggagggagaacatcagaataaatagctaatgcatgttgggcttaatacataggtgatgggtcgataggtgcagcaaaccaccatggcacatgtttacctatgtgacaaacctgcacatcttgcacatgtatcccggaacttaaaattttaaaaaaatttaaaaaaaaagaaaatctgaacttgggtagcaatatctctacctaatgatactcttgatttttaagtacttaaaatgagtctgaaactgtagaggaagaaaaattcttcctaccaccctcctcctttctctggctggggctttgtaaattggactgacaaagacagcttaacaagagagaagcaggagtttattagtgtgtgcattgggctcacacgtgggagcactcagacgtgagtaactccaagggctggtaagaccttgagctaatatagaatctcagcaaaggaacaataaatttttagagaaatgacaagacaaaggaacgaactttgagtttctagggtggcagactgtgggaaagcaaatatatgggaaacctattgtagataaagattagttagggaagtttatgtggatgcctgtggttccgtctctggactcctaagggtctagagttgtctctgatgattaacttttatccttcctagtagagaggggagggaaaacacctttgcaaatttgtgtcctgcttttaggcaaacaggggcagggcagagagcttttcttatagctgttttctctcaaaattctgtcttcacatcaaaataatcccaatgccaaagtggcgtattttggggtggcatattcggctaccctacaggacctatgcaaagatatatctttatatatatttaaaccatagttttcaacaaagttggaaacaagaataaggattgatttaaaagatattatatagccattgacatcatgctgcataaaacctatttaattctcatctaactggtagattatacaaataataacattgctttcctttggatattagcattggaaagagtgttttttgccagccttgatggtgcacccctgcagtcccagatacttgggaggctgaggtgggaggatcacttgatcccaggggttcgaggctgcagtgagctgtgattgcaccactgcattccatcctgggcaacaaagtgagacactgtcaatcaagaaagagaaaaagaaagagagagagagagagagaattctttttccttttctttcaaggaaaaatcagaaaatgagtggttgatcttagttcaattaaagaaaacaaaacaaacctgctgggtgcctcctctgctctaaatactaagcaagaaataaagtgaataagcccctgccagtcatgtaactaaactctgaatgagggaagtagctaaaatgttacacataaaagaaagctgaatgggaaaaatgcatggaaattatgagtttagggacattttcacttggccaaatgccccattctctttctctacttccaggtcattgtgataggtattttaaatgaacttgaataatcccttaggacagggttgcctgaggaaatgggggacacccagtcaaattggaatttcagataaacaacaaataatttttagcagaattgtgtcctatgcttacttatactaatatatatacatatattttatttgcctgaaattcatatttatctgcactatatctggaaacattaagaataaattgtaacatcttgtatttgtataaggcaacattttaccaatcttttcttcagaatactagttttatgaaactcagcaaaaagggctatgtggtcccaaaagttgagaaggcatttcgtgctatagctcctcttgcttacagctgttaacttggagtgataatcacctgttctgacaaccagcatagactggactccttctagctgttaacacctctgcagcaggactgagaaaggactggagagccacgtgctatggtttacacctctgagcatttgctgtgtgccagccatcacactacatgctttacatacttcatctcactaatcctcacacacttatgaggaaactactgagagtgtatgcatgaggaaatgcctcagagaggttcagcaacttgcccaaggtctcacagttgtaagggacagagtctgaatctattgcctctatacttaatcaataaagattcattatatgcattagctcatcaaaggttctaagatgtctagagtaaggaaaatttttgactttgtttaaataaccatttcctggaagcaccatcgaaaacattggtagttgcagggtrcagtggctcacacctgtaatcccagcaatttgggagaccaaggcaagaggataacttgagcccaggagttcaagccccatctggccaacatggtgaaaacccgtttctactaaaaatacaaaaactagccaggctggtggtgtgtgcctgtagtcccagctacttgggagtttgaggcaggagaattgcttgaacctgggaagcagaggttgcagtgagccgatatcatgccactgcactccagcctgggagacagagcaagactctgtctcaaaaaaaaaagaaaaataaaggkrgggtgttttatatttatatctacataaatctatacattatctagatattatactatattatggaaatgtatatattatattagaattaatatttctaattatcgtatacagttatacattttattgtgttattataacatattatatataatwggttctgtttttctgaagagccataaataatgcattcaatttagaagacaaactcttttagttggaatgagcctaataaaaataattaccatcccaagccaactttaggttattatttgtctctgacagtattaaattatcattatattaaattcctagaagcactatagaaatggcagcagagtatttatattatatataatataggttatattattagatattaatatattacattacaattgtattatcatgatattatatataaattggttctgtttctcttgacaaccttactaatacatccagtttagaacataaattctattagttggaatgagcctataaaaataattaccattccaaaccaactttaggttrtcatttgtctttgatattattaaattattattattttaagttcctaggagcacaatagaaatgctggcagagtgtttatattaaatataatataaattatatttttagatgtaaatatattactttatgatgacattattgtgatatatatataatataatgagttctttttccctggagaaccttaactaatacatctagttcagaacataattctattagttagagccagcctaacaaaaataattaccttcccaaaccaactttagattatcatttgttttcaaggccatggttctcagccttagttgctcattaaaaatattcggggagggcaggcatgatggctcacacctgtaatccctgcactttgggagaccaaggcgggaggatctcttgagatcaggagttcaagaccagcctggccaacatggtgaaaccccgtctctactaaaaatataaaaattagccgggcgtggtggcacatgtctgtaatcccagctattttggaggctgaggcaggagaaccacttgaacctgggaggcagaggttgcagtaagccaagatcgagccactgaaaccccagcctgggtaagagagtgagaccctgtctcaaaaaaaaaaaaaaaaaaaaaaaaaaaaaaatacttggtgcacttatgaaagcctgcagagcccagaaattctgatttaattgatctaagaaaagggagaggtaaaagctcccaggaaagtctagtgcccagccaaaggccatgggagtgatgagtgaccctgcccacacctaacggagcgtcccctgctctgctagtcagtcaacagaacaccagccaatttctctaagccaagagctggttatttccaacctcccctggaagagtttacttaataccataagaagtmattttctcttccatctactgcaagaaaaaactggatattgcaattgccatcctttttgagttaaaatactctacatttttaaacaaataaataaaaaagcttaaccattttgaaattaccagtagggaagaaatcgggtgaaaaaggagaggaaccatgcattactgagaatactcctgtcccaaatctctctccatatccatttcttaaatttattcattcattttaaaaactcaacttacaattcttgaaatctttacctaggatatgtcagccagtattctagacatctggtatacatcatagaacaaaacagtcctgcccccatgaagtttcattctagcttacccctagtatatgccaggctctgaactaagtctaaaacagatgatccctgcccttccagctccctgcaaagccagcattaataataggagggctttttacagaaaatgaaactgtgacttgtttaagttacaacctgtgagtgttgaagtcagagtaccagtctttcctgtataccttaccacctatttgaaaaatgatggatagttatcttaaacggtgaagaattagtgtaagttcttaaacaaaatagtggcgatattaagatcatgcttgagaaacctaattcttgctgtctccttacatattttaagtttggcctaactctgtctctgtgcatagtgagctgtaatgtaactggatgtgtaaayagattgtagcctactcttgtgccaatctccaagttttggccaatcaaaggtggccaaccattcaaaccatgttcaagtaaggcaaacatcaagctgtaaccaacccaactatttttgtaccttgcttccattttccatatgtcacttttctttttctgttcataaattctctcctaccacgtggcatcacgggggtgctctgaacctcttctggttctggggctgatccattcatgactcattctttgctcaattaaagtctgataatttaatttgtctaaagttttccttttaacacgaccaagagtcacagaytgcttagtctggagaagctactcttggctctatgcagtccacaaaaaatgacatttagaaatggttttccttccctggtctccagagaagcagcggctttcatactctgaaatgcagcatcctcatctgtaagatgcaggtgctaaatgatgactgttgttctttcaaatgttaactttctatgagtcacttcttcattgtatgtgtcaagaagcacaacctcgaaagcctgcctttgacaatgcttagaggttagaggatgccaaatgagcctcatcttctttggctactgagttartaaccatccttcatttatctcagggagcaaaggcaggatttccgtgggtgtccaaggtccttactcacagtcaggatgcatggcagtacccttaataactacagattcagaatcacagaagacatttaccgartatgtattttctgccaaaccctgtgccaggtgttattagaacattacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaattcacatctgagttggttgcatgatgctatagttggcaacaygattctgaccgccaccatcacaaatagaggttagaaaatattacttatgtgaaaataaatgccatttctggcacctaaaacagctcttttctcaccttcctatgatgaggttttattgagcttttgcaggaaagaaaagaaagaaatctgcattcaggtttcaggagtaaagaggctgctcattaacaaagccgtttcaaaatctattgaaatgctccaccacgaatacatgccctattactaaaatcactgtcatttctatgcttttcttctcccttcaatcacataccacccagttttcagttcctataattgccaaaagccatttatgaatctgccttattgtatgggttacaaacgtctattttcctgctctgttcatacacatttgggagcaccttaagatgctgaaacactgrcaaatgcttaatatatttcatttgaaagaattatgatctaaatcttaaagaaacagtgagtaaagtgcagtttctgctgcttggttactgtagttcattcggggaatttcatcttggtcgtgttgaatgcagtggttagatcctgtgaagttgtttaattaaaggtgttctagtagtcaaagccatgtctaaaaccccgtttgtttaattctttagtaatgtcaacattcctaaatttcatgtagcctaagagatttttccactggcttcaaatctgagctttgccactttggtgtcctttgctatgaatgttcaatgaggcgttctgagatcaccaagaatagaagagacacacccccggctgtcagaagtttaaccttggagaatgccatgaagggcaattctggaagaaaaaagagaagggaattcctcgtaggtttaagatcagaaagtggggaaggcgggggtgctcttaaatgcatcagccctactgccagcacagtggggactattaacacatcatattttttttttcctgcagttactcaaccttgcagtgggacaagttgctcaatgacttaccaggagacaattgttatttttaaaaatgtctttcttattttaactacaaggacttggcttgcttagaggctcttgctcaggagtctttaaatgcaaatgagggaaaccccaggttataaagcatctgcttctgcaggttttcaatcctgttaccttagcaacatttgcccttgtattccacgcatcaccttgacagcctgcataatataagggacggagcggagcaggggctcggggtgggagcctggaaagaaaactggggctcaaggaggtttaatatcggttagtagcttgggatccttcggataacggctgggcaatgaaaataaaaagccccatttccagaaatcaaagaacttggggagaaataaacacgctggttcaaaggaggggaaaatatatcagaactagtcggacctaagggagcagatattttccaaaaatatccttcccaccagccatgctgcagatgtgtcactgtggctcagaggcaggccatctgctgcagtgtttccctggaaacccccagcaacgcccctcccggagctcctccgcggtctcccccactccatccccgcgcagcggaggagcttgccggtgatgtcactgctgctagctgggagggaatcccaggacctgcgtccctcgggtagagccaatcatggtcggctctggatgctggaaacctggggcttttaaccagaaagaattgcaaaagcaatatgcaattcatcacagtccacaaagcacagttcctaacagattctgaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatatatttcattataattgttgcttctgcagaaaattgggatagaaatctcagatgagctgtagttacacggagatctacagcaatgcaatgtttagctagcatgcattttgtcatccaaggctagtaggtgaaatatttcctttacctgtcttgatgcacggtggagaaakgagacccgcttcgttttccctctaatctagagagttaacctcctccaggtagggttgaaaatatgaacagagctgcttttgcaagactgtgttgcctctaaatgtgatttaactcgcatattcagaatcttagcaaaaataaataaataaatagtaagatggggtaaggcaaatacatagatattttggagatcttatcccttattcaaggactgtagattattacagctttgttgtcatattatytctaggcagtaaatcatagtaaagtagtaaattcatagggaatgaattaatctcctttttgttttgttttctctgaaaaagagggtgtgattacagcatatattgattgggtactgattatgggacattttcattgtatttgttgttgttgcagtagactaaatgtcgagcccgtgaatctcttgtgttggcattgtcagaaaaaagttgtattttttttaaactggtctaaaaggaaaaaaattgaacatatatctttatattttttttgctctcttctcaaccatgtttagtgttttgtttatattcaaaggattttattttcacacttacaattctttacttgtctgtcattcaaatctttgttaccaaaacagtttgctctttttcatcattcactaagcattcctttcacagctaagctaaagtgtctatatggaaacatacatayacacacacacacacacacacacacacacatgcacacacactttttccaggccacagacaggaagatatgtgtaaatgtatacatgttttcagtagcatatatacacaagggtctccaataagatttttctagaaacaaaggctgatactacttcatttcatattattgtaaagtgctaattctaagtaaaagtagactaaaaaagagataaaaataaagataaaaatgagtgggctctcacaaccttgtttttttctttttgtttttcacttactctcttggctttttaactccttccttctctgcctcttatgaatgacaccaggaagagttattgtaaacaattggaatttctaaagttctgtgtaactgttagtatattcactatatgcatggtataatttataaaattaatctttgaaactgttaacccctagaaacagaaagaaagaaagaaaaaaagaaagaaacataaagaaatcttgacccactataaatcctgttttctctgccatctcccccagttacacccagggcaagtctatcttcttcaaagacattcagtcagcccacagctttttatcttttcaaacctttaatggcaccattagctacggaaccttgatttccttaatttttcccccactgtcactgcaaccatcacatgtggctctcagagcttctagttccctggaaacaggakttctatctgccatcaccaggtataaggtgccaccacttgaagggatctgccctatcaaaaatgaggaaatatattgatcaaaatggctggagaaagtgaccagccaaaacacagcttcacagtcttgcctgttttaagtagattctatttccattttgccggtgacagcactaagcaaataagcaatgttgccaatccgagaacagcctgcattcaaggtattcaatcaatcaaagagagacaatggcattctctcaaagatcagatgttttgtagtgcaactatgttgttctgtttttctttacttcaattatcagatagacaggaaaaaatacaacaaaatagcatgtagttgatttgccaaaaataaatagcaaagaaaaaacaagaataactagaaaacacgtgacaattttagaaaaaatgtaatcacatttccaattactagacaagatataaataaagagcatttataaaatgtttaaatccattcttttaaaacgataaacaacttctctaactggaaattactgtgcagctgctactttgtattttattggtataaaataactttagagttctatttcattgcattgcaaaggtgtaatactttgccataattaggtttaaatcttgcaaaaatagaaacctgcattttttggttttatattagtttttttaggtgatgctattcaatgggaggatataattgctgtttctatgaccttgggtaagtcatttaacccctctgaaccttggtttccttctttggttgaaaatagagacagtaatacttgacctctctctccagattttgatcaggttaaagaggccaataaaaatgaatgtgattttgtaaatagtgatacacacatctgatgcactgttgtgtatttttgcacctcctcagcagtgctctagctagtctgtccttgtccttgtcaactgtacgtgaacatgatgccctctagtgactgcactttgtagatgctgtaggccccaaggaagccttgagaggaaaaaagagcttaatgaagttagagaagggaagggaggcccgtagcggaaaattatgggttataaaccaataaaagcagcaggaaaaataagcagcagctgactatgagtaagaggacaagatgcacaaagagggagaagagaaaataagcagaatagagagagaggtgagatgtagctgattttggaagagttcactgtggcctggaaggagaggaacaggaatctctgcccagctttgtttataaccggcagtaggtccttccgttcatgtaagctctgccctccacaactcaccctgtgactgcaaaatgagatagttaaaattaaggttcagaattctttgagtcaatgtaagaagatgagcgaaaagtacaatgaaaatgagaactgaaggaggaagagtctgtggaagcaatttccagaatcttgtttactgtgtctaaggtcacctcagtattgcagtaacttaataacaaccaagcggctgaatgaggcaagctcaggtggggtttggtcgatcgcaggatgatcctgtactcttgtagtaacaggagtgttttgcagtacagctccacccttcacaaggatccagcccctgtgagattgcatcctcttagactgaatgcctaggagtctcactgactacctgtctgaagagctccttcttcttttctgaattaatccttctttacttagaactatctgaggatcaagtgatcttccagtgggaggatatttaaacccagcttccccttgcaaattacagatgctataatcctgtctgcattaggcttaggtcatgctttctctaaacgaactgtgtattacaggaaagtaatcaaagtccacaagaactgtgtaattaaaccagtgatggtgcaaataatccagaagtctgtcattgctctctctagacaaaggatcactcaaagatgagaatttgaactaattttactgaaagacaggatgatgcagctgaatggaaagaacactgcataggggtcagaaggtgtggattttcattctgacatggacatttgctatctgcctgatcttctgcaatattctaaacttaacaaagccttatctatacaatgggaattaatccatttattcatatatattaaagattttcaatgtgccaggcactgtgttaaacttccagatggcagtgagaaacaaactctagaatttctgagtcatgataaagatgaaacaggtgttatattttaaaactcgaaatgtcataacagtgtaaggtactatgcattcctaaagcaacataaaacaatagggatttttccaaccttaaagagcagcatttaaaattgagtcttgccttgggagcctgtgacccacgggagcattggaaatgacatcaaccacgaagtcttttttcttccagtgaaatgcaaaacctgctacctccctggagctattagcttggccaaatagtcctctagttagtaagtggacaaagtagttactgcacggctaactgcaactcttcatttaaatatttccctcatgtccagataggatatgtctaatatcatatgcctaatagcttttcagcatctttccacacagaaagaaagggaaataagccttgtcatagccatgaagtgtccccaccaccagagtttcttctctgctacccctatgctgcctaggaatgctaaaactattttatggggccaccaggtggcagttagggcaaatggttttagtttttttctttctacattcttggggaagaccaggggcttaggaatggagaagcaagccttggaaataaaagcattatggagcatttgggggtgccaggccctgtgctatatgtgatatatgcaatacctcacccaatccttatatcaatatctgttaaatatactattgaacaggtgaagatagagtaatatgggaaataaaacatcttccgtaataagcagctagaaagtaccacaatgtaaattcaactgcagaagacatgacaccacagggaaatttcgtttcactgcagcagtgtctaaaaactgaagatggggaaagtgtagagtgtgttattaaaatgattttttcaaaaggttttaagagtctaaataaattgcataattagtcagtttcctwcctcctagtcttcctacctttagtctttatttttagctctcctgagtttgtagttgttctccttccatggtttgattctctccttagctttcagattctatacatttcacttctctttataaataatttttaaaaattcttcatgtgaacctgttcaagaacctgttgcattgaggactgaagatatggctctagattccttactgtttccggtagagaatctgcagagagaatatttcactgaagcaaaattataaatggaacatttgactttatatttccatgtccccaaagatttactaaacattagatctgatttggccaactttttctaccaatatttccggctcttgatatgaaactagttaaagctattttttcccttcaatcagcacattttcaaacttagaacatctattactcaaatttggcataaaattatgcagccagctcattatccactttctgcatattgccaagggctcgctacgtatgtgtgttctggttggcagacattttgggtaactactattctcaatttgtacctactttatttcaatacatgtttcaagatgagtgttaaagggtacattgctttaggaaacttgtctttttctggcatttgaacttgcctaaattagaaaaaaaaattctggttcyagtcctttttttctaaaaaaatattccaaatcattagatgaaactgttaaagataacgtttggaaagtttgtctcctcttyggtgattaaaaagtgctttccatttttggcccatggctcttttcctggggcatagcatttgattataaagcttttctgatgaaagtatcacaggayagcaaacatgagaatgggagaaataattttgcatgcaattttttgtcatctggctgcactgtatgggaaatacattttccctgtcaaaatgtcaagttgttttgacttcacaacaaaagaggaaggaagttcttaaatgtagaacaataactcagctcactgctgatttctatttgttctatccttacatcacagtatagagatagaatgtgtcctacaaatgtccatgcagcaactcatattcacttggcataattttgtttattgtttgagaaagtagtattttgggtaaaaattctgaaacaggcagtgagtatgtctgagtatttctggcaagggctatttcttcctttctccttttactctggagttttcttgaactgagctgtttggacaaatgacacatatttcaagaattccaactgtgggagtgtttcactcacaggattktgctttcttctaagagccaggtctggtgaacactctcaggagctttgtaacatgttccaagctatgcagaagtgcttagttcattcactagtcaaagactaacacatttacagcaataaaatgcattataagcattctttcttcatgaatctattcatcccattaaaaaagcaggaattccaattaagtgaggtaaaatatgctaagtagtacagtataagatttttaaaaattacaccatgtttttcatggattattttaagaaaaaaactattttaagaaaaaactgtcctatttttggaaggtctagtcccaaactgcacaggaaagttagaggtaaactgttaaagtctttgagaactggcatttttcaagccrcagtgaatgaaatcaagcattyctctgtttctcctttcctttcggaatttcttttcctgaggcttgagaaggcaatactggtcttacttttcacatgagtyaagtttatactagctgagcaccctgaatcattaacgtctttctccccaggggagaccaagctcaaatccatcatcagaatacatacttagaccctctcccttctttctggccccctgcttcttaggaatgtgctctaaccaccacagcattcctgatcaccacctccagatgacaaaaagaaaaaatgagtggcagtgaaccagaagagcttaggccatctattttatcctaaaatctgttcagaaatacgaggtttgtatcaattagtaagcacactgggaatacaggtatacaagttgttagcaatatttggttatataatgtctatagatayttattttgctttctctcagatattaagaattatgtctttcctttaacctccatcatttgtttttctactttggtggaagctttttgtttgtwtctttactgcaacagtgaatttatccttggatttctccattatgattggcagtatttatacaataatttcttggtattagttaattgataccttatatttactattttcccccaaagctgagtaaagaatagaatgaaatggcctatacttatcagtgtaaatggatattagaattgctgctcttattccaaaaaatakcactyaaagttcacaaatgaaagttaataactgaattttagtaacaacaacttcaacttaaaaaattccatgtaattaatagctcatgagtcccactgagataggttgaacttcataacttctaaagccttttatgtttctactacttttcagttctaatgttcaatagtagcgtgagtatctggttagtttcagtataaaaaagatgatacccacttgtgatatgattctactttcaatgtcacggtggaatcatttattagttttttaatttaatttttcacatgtgagtgtgatacagaacacctgatttttctacactataggatgtcagttcagtaaatcgattttcctcattagcaactgcttatcaatgactatgctgtatagaaagcaagagtattatactctatttttgatcacagataattgaagtaaatttaattagatccatatgaaagaaataagaactctcacaattgtgacatatatacgtgtctgtgcatatgtcatatcttagtatatgaggtatttgcatgtgcatacttaccaagttaaacgacctcctatcccacaaagttctctttagaaataaacttgagtctcttgtttgtgaaaccaaagagaatttcccgccaaagaaatacctacaaagaagtgtaggtaaagaattcaaatgattgactcaggcttaagatgatttgatagctctttctgcaccaagaaacacagaaaatctcaaagcaggcctgtgccaacttggtataaaaaaagccttcctaaagagtgcattatcttcaatgggaaacgtcgcagtacaccttggcatcaccaggtcaattagtgcaccggaaagatgcatgatatttcctgttggcagccacgaagtgagagaattggacggctactagccctgttgtgtgccaaggcctaaaaatcatgcaaggaggtgaaatgatgcgtgccaagaaaatagcaaccacaggaaacagcaaataatgtaaggttttgtgtctttactctagatgtaaatactcatttaccagggcagctttaaattgacagcttttgggtttgtgaggatattgtgagtcagggttctcctgattgggcaagatgaacgagtgaacaacatcactagggggccggagtagatgagatactcactcattcgtgtgcctgctttagcaccagcagtgtgggaatggggagaaggccaatggtctcaaggcagtttccagctctctggcaaacaagataaggccatggctgtaacagacaccctctgccaggttctaaaatctctctcttatgacctttttaagatctttaaagcaccgtctgcccttggccaacaaaagagaaaaaacagagtcaatgcggaaaacgctgccaagacaacattttcttcttaagatcctaaaagcaccattttccctttgctaacaagacaggagcaataaagagtcaattaggaatatgttgccaagacattggccatataatttctactccagtcggttttgggtttgatgcagtttagaattctctagacacattttttcatttttttttcttactagaacgcagaatgtttttgagagtagaggtggatggcactgctcattagaaatagctgtcctgccccagaacaatcttcaagacaaaggttgcaagactatctttgaccttcctgtccctaaacactccccaaccccaagccaaacacgcgcctaaaagttttcacaccttgccctttactaacagcaatcatatttaggaggaatatattattgttagtcaggaaaytctacctggcttcaggaggtagcttagtgggtatttgctaagtctgatacctttcctttcaacatttagctgagattacctatactaagagcacgaactacaactgtggaaaacagaagaaaggagaatgttctccaaatcaaagtgtgctaaggtcagcttggggcagccaacaattcctggaaggtgacagagataaagttgcagagagggaaatggttgaagacaaatgtctcacgccttaaaatgttgctaaagtaagatggctgtttggatgagtcatcaacaagaacatcacctttgctctcttcctgccacccctgcacttctcaggctactgctcctaaaacctagaactcaggagtgatggaaatagagggcacccatggcaaggaagaaattggagagtaggaaactcagggaagttaatcctgaggaaagtggaaagtgactaaaacattttgagcagagaaaagtcaataaatcaaatatagaaacaagagatgataggaggttctcataacagtccaaatgagaggaccaaaaggcctggagtcacgtcattgcagtaaaatggaagaaaaaacaagagtataaatgaagtgtcaaagatgttaagaaacaggatcttttaaaaaattatttttaattattatgggtacataataagtgtatatatacatggggtacatgtgaaattttgatacatacaatgtataataatcttatcggggcaattggggtgtccatcacctcaggcatttatcatgtcttrtattagaaacagtccaattctcctcttttagctatttgaaaatatacaataaattattgttgagtatcatcactctgttgtgctatcaaatactagatcttattctttctatctaactatgcttttgcacccattaaccatccccaccttctccccatgctggctatccttcctagcctctggaaaccatcattctattatctatctccatgaattcactaggagaaataggatttttgactaatgggtcagaagaagcaaaggaaaggaaaggaaaggaataaagaatgactcaggtttcttgcctaggaaattggttaaaaaaagggtatttttaattaaaaaaggagagttgaataggagactaatttgaaggagaaaatagcctatttttagatgtattaaatttatcaaatttgtgtgctgtatatcagggctcaatcacaattctggcataaatttatatattttatagaacattattaacttgaaagaaatgcatgtattttgttaattgatagaaacaagatcaaagggcatattatattattattccgctttgtaaggaaaaataggttttgcatatttatataaaaagggaaattgaatgtgatatactctggggtattaataataattgtgaattaaattcctttctttagtttatattgctrtctcaaatcttctgatttttctaccttgaatgtaaattttttgtttgtaatatggcactttaaattaaagttgtttttcagctgggcacagtggctcacacctgtaatcctagcactttgggagaccaaggtgggtggattacctgaggtcaggagttcaagaccagcctgaccaatatggtaaactccttctctactaaaaatacaagcaaattagctgagtgtggtggcatgcgcctgcagtctcagcaactcgggaggctgagacagaattgaattcgagaggcggaggctgcagtgagccgagatcataccactgccctccagcctgggcaacagatcaggactccatctcaaaaaaaaaaaaaaattaaattaaagttatttttcttttcttccattacccagactggagtgcagtggcatgatcacagctcactgcagcctcaacctcctgngctcaagtaatcctcccacctcagctttccaagtaactaggactacagatgcacaccaccatgcctggttaatttttgtaatttttgtagagatgaggttttgccatgttgcccaagttggtctcaaactcctgacctcaagtgatcctcccayctcagcctcccaaagtgctgggattacaggtgtgagccactgcactaggccttaaaatttatttttcaaaaacttgatgattcaaatcattgaagatgctcttatgccaaagaaaaggtagttctaggaagttcatggaatcttacaaacacctttacagctcaacagaattgcaaagatgggtagtgttttgttttgttttgtttctctgattgttctacagcttatagatactgaggttacattttatgaaacaaaagtaagaatacatgatttaaaagtaagatcaattcctaaaaattggacctgaaaattttatggatagagtagatagacgtgtagaattcatcccagcatagagttgctgggatattactggtgcttcttcacagggaaagaaacctggctacccagactacaaagggaaagggggaaaatggcctataactcatatcaggtgaattagcaaacattctcatttcagacgatttttgctgtccctggtcatgaaatttccttaactgggttctatcttttactttttatcccaggcttttagcaagggtcataggaaaatggccatttccacatatctggtatatcccatttgaagatattgcctaacaaacattactcaggatcccttrcataaaaacctccatgataaatttcttctgtacttttttccccaaaaagctggattctcctgtaaaactgttatctattctctttatatattataattatggaattcattatcatttctactcttatctacatgactaggtcaccaacagctaattatatagctaattcatggtagttaattttatttacttctcttaagtcatgacttacaaaattgcatttctatgtatgccatcttattacctccatttatttaagttgcatactacttcacatttcctttgaagtgtatattattattagtagtagtagtattttggagacagggtctcactctgttgcccakgctggagtgcagtggtgcaattatggctcactgcagcctcaaccttccaggctcaagctgttcacctacttcagcctccccagtagctgggactacaggtgtgtgccaccatgcttggctaattttttaaaaatttcctatttcttgtagagatagagtcttactatattgcctaggctggtcttgaactcctggacacaagcaatcctcccacctcctcctcccaaaatgttatagacgtgagctaccacacccagccatgagtgtacattataaataaataccaataatgtactttcacatatgaaaaggctataaaagtatgcaaatatattatggcaacatctgttaagggataaagtgacacactgttgctcataactcgaaagaatatatatatatatatatatatatatatttttttttttttttcttttgaaacggtgtctcactctgtcaccaggctggagtgcagtggtgcgatctcagatcactgcaacctccgcctcctgggttcaagtgattctcctgcctcagcctcctgagtagctgggactacaggcatgagccaacatgcccagctaattttcatatttttagtagagatagggtttcaccatgttggccaggttggcctcgatctcttgatctcgtgatccacccccccatcagcctcccaaagtgctgggattacaggtgtgagccattgcatccagcctcaraagaatagtataaaccttatgtgttcatataagcagtagaacctatccctaatagttggattttattgtgtaagtgtttcattaaggaatgtctgaaacatgtccagatttttatttcagtggcttagttttgccacagaacttcagttttataaatgtgtgtactggcttaactgtgaaagtattaaaattattgtattgatttttgcttgcaaatgaaattcataaacagaattatcactgaaatttacatgcaagagaaattgatcaagatgatttgaaaacttatggaaagattgaaggttgccaaaatctttctctttctaacttcctacctttatgtacatttacactctaatcacaggtatttacaggccttaattttaacgaaaatgaagaaaaccaagaaagaaacagctctttagagcaatggaaaatcttctatgatttctcactgacattggctagatactctgcatttatgagcaatcatgcatgtatatcatcagatttaaccttcacaacaattccatatatattatcagatttaatcctcataatagtttgctatcctaggttttagtttagaaaactgagcctcccataagctaagaagttacttgtccaatatcacaactttagataatggtagacttagattaaatccatatttgctcgctctacattccatattcttcccatttaattgaacaagattttggaataaagttgaaatccacaaaaggaataggacagtgacttcacaataaaaatattaaatgtggcagaaagtatggatgtcaatggaatgtaaattctgggcctcctcaaaaacttgatatactcatcctgtgttagttgtgaaataaacaggttggagagtgaggaaatgtggtttttgttcccagagtcattactgaccaactgtgtgctttgatattatatttgctttctgatactaattatattaattctcgctcatagaaatcttccctccttcataccccacctctgtttgattcttaatctcatacataagaggtttttattcaatgtctcatttttctttccaggacaagtatgttgtaagaattaattartagtcttagaaccattcaagcagtaggttctaattgagtatttttctccccggttagcacagcaccctgtcagagccctcaaagtcagacaaagaaggatgaaacatgttttggtccttaataaagaactgctgattgactgtttgaaaaacaaatgccgcacacctgtaatcccagtgctttgggaggccaaggcaggaggattgcttgagcctaggagtttgagaccagcctgggcaatatgatgaaacctaatctctacaaaaaaaaaaaaaaaaaaaaaaaaaaaagagccgggcatgaacctgtagtttcagctacttgggagactgaggtgggaggatcgcttgaaccctagaggcagagttacattgagctgagattatgccattgcactctaccctagggtgcaagattctgtctccaaaaaatgaaaaacagctgtatggtttggagagccagtggctgacaaactgaaggtcatggctaacagagtctccatatcagtgaatctcaaacatctgtttacataaatagcatcttcttataaaaaaatacaaattctgagcccccatcccattatagttggtaagtctaggatgagaccagaaggggtcattttaatgagattttcagatgactttgaatttatatttaatatttattctggtttgcctggggttgaagggttccccagggcatgagactttcagtcttaggcaaactggaatagttggtcactcagatttcggtgcagtggttaaagttaacactttcaaaaatattgtagtgatctagatttggttctaggagtttggctcaattcagggctaacaaaaaaatctgtttagggccacttggggattagtgattctcaaaaggtagtccttgaatcacttactgaatacctatagttgaagaacagataactgcattttaacaagattcaaaggcaaattaatgtttgatgaccgttgacatcaagtctcagaatcagaactgttyaacttccaagcaaatgaaattactaaactcacttctctgagtgaggctgagagcaagaagttaagtataatgttttttgagctaaaatacagagtctactatcagaatcctgtttcccaccataaggattaagatttttttgtttttgtgtgtgtatgtgtgtgtgtgtgtgtgaatgtgtgtgtgtgtgtttgttttttgtttttctgaagtgaatgacatcgttttttggaatgaaaaggtcttgccccaccctgcaagtgtatctctgcctttgagacaatttagccctggaatcaaacctgggggggaaaatcaaattatgatattaaagaaaacgctgacaaatttctaaattcctttcctctactccctgctgcatacaacttccttctttctatctataaatactatatctgctctagaaacgtgaaaaataacataaatattgaacagagtgtgaaggaatttaaactttattgatgagtagtagtattacccttctggactgatgcagatgagagcaccataaagacaaagtgagttcttttggtccttaagccaygaattggagtctggatagtagggatggaaatgggttattagatcatcagttcactttcctctccaagcagcaattaaatttgttttctttgtctcagcttactcgttgctcaaaaaaaagaaacatttcagctcctcttcatggggaataagaccaaacatagaacacttttctcttaacatgtgtggtgcttgagaggagaaagaggcaggaaggaaatgcaggagaaatgtgggaatcacagttaacctgaaggattactttggctgtccccttcagctaatgtgaacattctggcagtcagatgcagccctgtgagaaacatctatcagacatcctaagtagatgctccaactgctgtttttcatgtacagctgactccaagatgagtgtgatgctatcacggtgcaggataacagagatgtaccgcgaacccaacactcaagatgggaatgataaaacttcaataacaaaaacaaaaaaacaaaacaagccacactatcctttcagccttcagggatcgcctccttaaactgttttctaaaatctttctgcactttatatcaggtrcaggagaagtagactacatacattatttgttgtctatctttgaaaggatttcattccctctactgcacttaatcattcccttatctgaatattaactcagtgtaaagcttcccaaattttccaagttcttgaaagagagcaaaacatattgcaaagctctatatgtttcctgctagatatatttcgtgaaagacttcattatgtccactttcttttgagtttttgtgttagccctgcattgctataatttccaacatcccctggaacataatgaaaaccagagaattgctttttttttctgggtccattttattacattcttttacatctcttacttaactacttctaatgcctttgctctgaaactttgtgcatttgagggtttttttttccccgtgatttggtggactgcaagggcacacaaaactagcttatttttcctagtcaggcagttttgaatagaaggtgattgtgttttccagagataagtatgtaagtcttttctgctaccggaggaggattctattttagtagtctattaagtagacaataagcrctgagttatgagttgataagtggatctgcttaccacctagaaacatcaattgaaaccacagcttatggtttcttactgcctctttttggtttctcactgagtctttctggttattgttatcatttcgtttttgacttgggcttggactgttcagcttggctgtgttaatttttcagaatcaatgacttttatagttacttccatgagtttttcctcctgcattttatttaagcaattcactaactatttataagaccatctttgaaagcctgagatacatatctaggcaaatatccatggaaaaaataaacactctgcaaatttgcaaacaaatacagcaattgccaaagtagggttatcttttgcaatcagtactgtggtttcagtttgaaaaaataaagctttcttrtcagttttgctccaagggctatctgattcggtgtgtagtcggtgaggaaataaatacaggtataataatctgtgcttgctcaaaaattaaaaaatcctttaggagggggccaggcgtggtggctcatgcctgtaatcccagcaatttgggaagcagaggcagacagtttacctgaggtcaggagttcttgagaccagcctggccaaaatggtgaaaccctgtctctactaaaaatcttagctgggcttggtgacatgcacctatagtcccagctacttgggaggctggggcaggagaatcgcttgaacatggcggagattgcagtgagccaagattgtccagcctggacaatagagactctttctcaaaaagaaaaaaaaaaaaaaacctttaggaaggataaaactcatttcctctatcagcatagtgtcaccatattacagaagtatcaaggtcaagtattaagactactgaggctcaggtgtccttggctgaagggagagagaggataccattcttgcatagtcttcagggcagcagtaatcagcaaactgataggttgcttctgggtctaaacccactgtaatcatttgcttgtagagatgacaaagttatcagttgtacttacatccactttttttgttgtttcagaagcttaccacacttctcccagtttccttttaattagtttgtaattttaaatcattacattaagataagaggtttttattaaatttggtagaactcatggtaggtcctacagaaatcactgaacttggcagccaaaaacagtgaccaggctgaggatgtgcctgaattgaacagggagatgctatttacttcttaacagagacatacttttcacgcagaaacttggcaactggaggagaaaaacacagaggtgaaggggaaagaagactattctggaaattaacaggtttcaattttggttgttcttcaacttgttagctatgtggccagaaataagcctcttaaactctctattccttggtttcttcacccactactctaaatctgatgaaacagagcagtaagaatttcttaggatatagcttaatttatttttttttaaaaagctcaatctaaaaacaagcttaatttaaaacagagacaaacaaatatgcctaactttgagttttgacaaaaaatgcaaaagtaattcaatggaggaaagatgagctttaaaaaaaaaaaagtgatactggagcaattggatatccaaaggcaaaaaaaaaaagtgcctaaattcatttctcacatcttatacagaaattaactcaaaattgattacagacttaaacataaaatgttaagcaataaaactttaggaaacaaacaggagaaaatgatgaggacctaaagctakgtgaagaacttctagacttgatactaaaagtatgattttcattttaaatgaattttaaaatgaatttcaatgaattttaaaattcattttaatcaactgggacctcatcaaaattaaaacttttgttctgtaagagaccctgtgtaaagaattaaaagaaamactacagagcaggagaaaacatttgccaaccacatattcaagaaagattttgtacctagagagtataaagaactctcaaaactccacagtaaaatccaaacgatccaattaggaaaatgggcaagaaacataaacagaaattttaccaaagatgatatacagatggaaaataagcacatgaaaagatgttcaatatcattagccattaggaatatgcaaattaaamcaatgagatagcactatctacctatcaggatggctaaagtaaaaaagagtaataataccaattgctggagaggatgtggagaaactggatcactcatacattgttgatggaaatgtaaaatggtacactctgtaaacaatttgcttgcttcttataaaactaaacatgtatttaccatatgattcagcagttgtgctcttggacatttatcccagagaagtaaaaacttagactcagtaaaaacctgtacatgaatattaatagctgttttatttgtaaaagccccaaactggaaacaacccaaatatccttagatcagtgactggttaaacaaactgtagcacagctatactatgacatactatgaagcaataaaaaaggaatgagctattgatacagacaaaaccatggatgaatttcaagggaattgtgctaactaaaaataagccaatcacaaaagatttcatgtgatgtgattttatttatataatattcttgaaatgacaaaaatatagaaatggagaacagattagtagtttccaggggtcagagagtagaggagggagggaggtgtgtgtgtccataaaaacgttgcgccagggatcctggtgaggaagctrttctgtatcctcattgctggtgttcacgtgaatctacatatgtgataacatttgatggaaccaaatacacmcacaaacacacacatacacatatgagtgcatataagaccagagaaacttattttggtggattccgtaaatgtcaaatctttggttatgatattgaagtgtagtttggcaagatgttactattggggaaaatagtaacattgtactattgtcctgtgaattattgattcacaggaaattgtaaaaaaaaatgctttgtcctatacatttttttagaatttcctgtcaatccataattatttcaagataaaaaaagttttgtaaaggaagaattttkgagactctttcagattttttattttgagatttaatcwattatatgagaaaaataagctttaactgaccactctttccttcctatccaaagcttagtcaatgagaaaatgttgcaagagaaggagaatggggggtacctgagactccaggagagtacataccctttttaaaaaagcaatacaagccagcagaaaaaggaargatgggactctggagcgattatgtgaatctgtggttctcaaagttcagcatgcatcagattcccagagggcttgtttaaacaaaaatttctgccctgcaaccacagagtttctgattcactaggtctgggggtggtgggtgtggttcaagaatctgcatttctagaaagttcccatgtgatgttgactccagtgctgatgctgctggtcaraccacactctggaaactactgccatagaacatctgagagtcacaatttgaaactgtctcaagaaatttctaagtaaaatgcaatgcaataaattacttaagaattctctatatttacaactctttatttgwatagtttccttccccctcagtatgttggctggtaagaatgttctttttgattattcatctgtgtgggctcaagagtgtgtcactgagttaatttacaaagcctcggattgcatatccatcacatttgtagaaagtattatcccagaaaaatccatcaacacaacacataagctccaaaatgtactgcacaattggcgtgcaatagagtagtcaaagaaccaatgaaatgyaaaaagttatctatatggagatctcaaaatgaattaacaaattaaatcctttgacattgtatgagatcccattagggttcattgttacagttttctttaatgtttctaaaatagaaatgttgtcctgggcagagcagtgtaatgtacttgctttggcatcaaatgccacattttttttttttttgagacggcgtcttgctctgtcacctaggctggagtgagtgtgcagtggtgcaatcgtagctcactgtagcctcgaactcctgggcttaagcaatcctcccacctcagcmtcctgagtagctgggactacaggtcccagstgcccagctatttttaaaattttttgtagagacaagtcttgctatgttgcccwggctgatcttaaactcctagcctcaagaaatccttcagacttgtcctcctagagtgttgggattacaggtgtgagcctccacaccaggcattgtttctattttaactttgctacttacgagaagtcttaatttgaccaacaactaatgtaagctctagtttccccatatgtaaaaagaagataatgcctaaattgcagggtttattgggagaattaataagaacacgcctaggccaggcacaatggctcatgcctgtaatcccagcactttgggaggccaaggcagctggatcatgaggtcaggagttcgagaccaccctgaccaacgtggtgaaaccctgtctctactaaaaatacaaaaattaggggagtgtggtggtgggcgcctataatcccasctactcaggaggcttaggcaggagaatcacttgaacccgggaggcggaggttgcagtgagccgagatcgtgcaattgcactccagacttggcaacagagcaagactccatctcaaaaagaaaaaagaaaaagaaaaataagaacacgtctaaaataattagtgcagtgtctgacacttaagttctcaaatagtggcggtgaagatgtgaaggagggtagagatgactgtgattattaatcatcttatttgttgatcatattaaaatgacaaaaaccacaattattttgcaccaacctaatatttcagcagatgtcctctgaatcagaagtaaatagccatgataatcttaccattagttattttattgagcaattacaagtcccaggctcttacgtttttatattaattttttacaaccagtttatgcgatgcatactgtcctcatttatcatataaggaaactaaaacttaaagagtttaatatattgctcaaggttatccagtgtattggtttgctagggctctgtaacaaagtaccacaaaccaggtggctcaaacaacagaaatgcattgtttcacagttctggcgtcaaaaagtccaaaatcacagtgttggcagctttggttccttctgagggctgcaagggaaagattgttctgggtmcttctccttggcttgtagatgtctgtcttctccctgtgtctctccatgtcattttttcctctatgcatgtctgtctctgtgtccaaatttttccattttaaaaggacattagtcattgctgggcacaatggctcacacctgcaatcccagcactttgggaggctgagagaggcagatcacttgaggccaggagttcgagaygagcctggccaacatggtgaaacgtgtctctgcaaaataatacaaaaattagctaggtatggtggtgcatgcctatagttccagctatttctactcaggaggctgaggcatgagaattgcttgaacccaggaggcagacgttgcagtgagctgagatcatgccactgcactccaacctgggtgacagagtaagactctgtctcaaaagaaaaaaaaaaaaaaagggcattagtcattggattasggcccaccctatggaactcattttaacttgatgagctctgtaaagaccctatctctaaattatatcacattctgaggtgctgggaggtaacactccaacttatctttattgaggggggcagaattcaaatccatagcacatagtagtaagatgtcatgctgaggtatgaaccagacttcatacgcaatgctgtggactaaacttttgtatgcctgtgaaattcatatcttgaaggcctaatctctactgtgacggtgtttgagatggggcgtctgtgaggctttaataggtttagatgaggtcaggagagtgaagtgcttgtgttggaattagcacccttataagaagaaaaaaaggccaaagcctcctctctctctgccacctgaaaatgcaacagggaatggccatccacatgccaagaaatgggcccttatcatacaccaagtcttcctgcacattgatcctcgatttctcaggttttggaactgcaggaaatcgacgttcattgtttaagccacrcagtctatggtattttgttatagctgcctgagctgactaagacaggcaatatatgacatggccgtttgctccaggacttttaggaaatgtggatcccattggtagtgctcagcaatcaaatttatttgatcctcatgttcagcagacatgttgtttttttcttcatgtattgccaactcttttatatgatacataaaacatattgaaaaacgtagacttgctatctttatattccacatgttggcagattctttccaagaaaagtgattttcagatcattccttaggagcgttgaggctgagaagtggtctttgcatatttatatttagaaattatcgagtccaaaatctaaatattgagtcttggtagaagagaaaaccagtcacaatttatgtaaaatagttgttcctaggtaatgaaccaaagcagggactatatttgagaagtagaatggtattgtcaaagtcagtgtacaatcaggaaattaaagagattattttatccaaactattgcagttaatgaggaatgtctcaaaagaaagggaagcagggttttatagatataggggaacaaaaagtttaagggatttcttaaccaccacttttttctagaagcatagggattaggtcacattcaacattttcagtccccacttctacttcagatcaataaacattataggatgctgaacaacatagaggtgatcatcagaaacctgagtaagactgagcagggtctaagaaatagtctctcaagagttcttgttggcattattgtcgtaacatcacctaaaccagctgttgagaagtagtggcaaaggccagttgtttcaaagtcatagagatcaggctccttaaaagagaagtatttaaaatgaaaaacattaatatcaaagattatgttaaagaccagagtttaaccctgagcataccagtccagcaaattccaaaaggtgggtggggaaaatctttcagttacacagtaccrttcgttgagtttcttgaagctaggatgtcaatgttcttgatgatgttcagtctcggttagctttcctctaagagaatgaaggacctgagcttttcaccagaatttgttaggggctcagacagtggtttgtgcagggaaaagtctggcctgcgtgtaatctgctgcagtggtgagttcttcaaagtttgaatcaagtagttggacttcagctggcagaatttcttcaactcctggagaaaagagctagctgctagacaacctagagttccaacaggaatctgggcaatcagatgttatttttcagtgacatcaagttagggaaagagagaaaaattggaaacattaatttgtagggttgtagccagatattgaagcaaactggaaggcttcacagtttggtacaaattaacaatttgggcaagataacaggatccagttcaatttttaggaaggtgtccaaactgctttttccacaraggaggggaagtcatttaaatcattccagacaagtcagaatttgcatatgtatcagttacctgcaatttatgaaactgtataatatggctaagagataattatgtctacaatctgataaacaggaaggagctgcttgctatagttttccactgaaacaaaacatttctctctatagtcacccctcttttgatcaaaaataatctcaaagaaagattattcttgatcacaaaataaagctagtaccatcagatttggcctgattatttacatkgttgtcttaaagatgataattcactacatagggtttcttatatttgctttgctgaaagttttcataaggaatctcaaattgaatttttaaaaaccacttgaggctaggaagctatatcaagaactcaccaacagatttacctacagtatctataaatttcrgtaaatgcctctcttttagaggtcccaaaaatatctcaagttttctgagcctgcgaggaagtatcctttacctgtaaatttgggcacctcattagccagraatcaggctgrttttcccaagagggctttaaatgagcatacctaatgtttccaatatttcatgcaaacaaggaagagttttattgaacctatgcaaataactataattttgaaatataatgagaatactcagtaagaatttctgatttctctaacagtcaggcaggaagaaaaagataccaatgacaaatgtttcatttatatttgcaaagcatagacttctgaattrttatgagtttcagttagtttaagagaaaatagaaakaagtttcctatgtccaaaaaatcaaccattaaaatatcagcaatattccaaacaaaagctacagtcattcctcatcagttccttcagtcctgtgtaattcttgctctgcttcctcttggcttaacagtttcatgcatacatctgcctctccaaacagggctctggaaatcctgactcagtctgctggtatggtctcaaggttgtgtaagtgacggcatcagaagcttctgccccaaatgaaaagtacctggcatagagctttgccatggggctctgagataatcctttgttragacaaagcactacagctagatttgtaagagctttcagggaagcaccacaaagcaaaattctatttgtaaatgacaaaagccttaaaaattactttgaaaaatcattttcaaacgtgaaagatgtaaggagtgtttatcacaagaatctccatttgaaaaatactggcttataggcacagaaaaacaaagatagtatgttctcacttacatgaggaatcttaaaataatcacactcgaagcagatagaatggcggttacaggggatgggggtggagggaatggggaggtgatggtcaaaggctataaaatctttattaggaggaatctgtttttgttttttgagttctagtgtacagtgtggtaagtgtagttaataataaagtgttgtacatttcaaaattgggaagagtaaatttcaaatgttctcacacaacaaaatgactagtatttgaagtgatgtcgttaactggctcaatttaattattccacatggtaggcataaatcatattatcactttgtaccccatatacttacaatatcataaattgtcaatttacagtttttttttaaaaaaaaggaaagcactggcttagaakaagctaatttgaaattaacgaataaaagttgttaccaagttaacattttaaaaataactgaaacttatgactcatgtggtgctctctaataacagggcaaagtgacatcgggactcaaagaaaaacacgttatggacataaaagcctttgatgactctctaggaattttccatacagcatacaatttctgaaatatttatactgataacattctgcccatacagatttgtcctagggaaggttaagcatctcttctgagtwggcaatgactcccgtgcaatttgtaaatagtaacatatcaaataaacctaattcttttcagcaactttcttttcataaggtgaaataacaaatcctttgtgattttcaaaggccctctgggagatatcaaagacagtttcagatgcaatagatatcacttaggaatcagttttgggagggaaaatatcaaaagttgtcaggagattgggacactttactaggatacggtcgtgagttactgataaacaatactttgctaccttaactaaggtgacagcaaaaagagtgaaaaagtaagcacaggcagtaacatgattgtaaagaatcttagctttttcaaaagggagaagactttattaaataagcaaggacgtgataaactcaatacacaatataggaagttattttaagacatgkaatctttgccttctaggcagattactcagaaggtaaagaaaaaatattattaagagtagactaagaagtyaagaaaatgttatgtttttaaacagaggcaaaattaaattctactttgcatcattatggcatttgatattaaagatctttttgaaatcttataaatgaattcatcaagccttagctagcactgaccacagcaaagtttgtttcccacaagcgttttacaactttctacgtctattcagcttttgtcctacacattaacaactagctatatgacttcagaataaaatgactctatttttttcttaacaaaaacatgttctgcaaaccttgcatacaaaattgtatctctctgctattattatgccttgtagaatctcattcatgtatattgattataatttttaaatagaaatagtaacatctgttgcacaaagaaaaaagggaaatggataattgtgatctttctgtcatacataagctttttgtaacacactagtggaactcatgaatacacatctcacaacttttaatagccatgcatattatttacagcacgacttatgcaaagtggcaaaaatgaacacatttattaacaaaactgaatgtacatgcttctctatagcatatagaaacaaaaggcaaaaaagtatataaacttaaaattatgcttggttaccaatatttcacttttctctcttgcatagaaattacataaatatccaattaatattcattaattaattcaatttagcttcaatccaaggttttaaattaccaaatatcttggaatttgtcttcaggctgacatgctccaaaatattagtaccattgaaagtttgttagaataatgactcaatttgcttaaacacaaatttttattttctattgtattaaacattaagtagaagtaatgctaggttatttggttggtaaatctaagtttaggaagaacattcacaagtagaatagaagcatacttgtgttatatttaacactaaaaactcagagaaaacagctatttttactaaatcaacctcattaattgattatcaaaataataattattgttaaatattgtttgccaaacatttacctagattttgtgaacttgaattattgtctctgagttatgttcctacaagakacagctttttcccctacagtaaaagtgtttaaggctcaatttcctcaacttctgggaatttgggaaatatttggtttatataaatggttatttatttctaagccaattagaatagagctcctttaagagattctataacctaatttagcgacaccatcctgaggtagggaaatattttatttttatttttttcagagatgggctagattagaactcctgccttcagcctcctgagtagctaaggttgcaacttccatagtagctgaaattgtrggtgcatgccaccrtatctggccaacagggaaatattacatactctaacaatgagtggtgacwtcctttctgaattacagacatgtagacattaaagcagagatagcaagaatttagtttccattctaacatttaagccatgggtcaagagtggacacagaatcacaaaacttactgtttcatatcaaagagctgttctgttctcatgattcttaagtgatttgagctcaaaacagacaaacagaaaagcgtagcaaaccaaattctctgttgtctttcacccataagatacaagatctctaaaagtcattaatcccctctcagagatcaccaagtggtcagaccacaaaaccaaagccagtgccagaaatcaagtgagtactaaaaccttgccttgctaccaatagacaagggtccatatcacaggaccaggagttagacttattcatagttccttggaccaggaatggagcacaaagggcccaaataagccttattacctgtgttgagtaaacaaagatcccagtgcaggagatccatatcatggcaccaaactatcaaatacaggatgcactaggtcattaaagagaagattttattcaaagcattgcaaaatggagaacattgatttatggtgaatatcttgaagaaaaggaagggggtctggggttctatagrggcaagaaaaaacgggagtcatccagaagtcttataaaagtcatgaagaagggtggagatgggtcttatctcagaatatgggaaggcagtttgggcctttgcattagttgtttgccagacactaaagggtagagaggtttcttaatcattactcttttccrgaagcacagggctcaggtaagattgaatatttttcatgcctttcatcctctctgtctgatctctttcaaacygtcttttttgttgaggctatatgaaatgtttactgttttaccttccaatcaactccataaaaacggttgatataaagcatctagccaagttccactacattttagtcattcattatggaacatcatcccaaggaaggctttattctctctgtctaagcaagcaatgaagggagatcttttggaaatggcctagtatttgatgagaagcaagaacaaggtctacattagtggatcacagactttttgccactgagatccaccatcgaaaatgcattcattattacctctgcatgtgtttatttaactgcaacaatagtttaatgattttcataacacaaaacttcacagtgtatgatgacactgataccttctagtctattcccagctgttctatttcatttttttatagcttatagtgactcattaaaatggatttccacgaatgcaatgcaacacacagtttgaagtccactggaaaatcttttaaaactgttattataaaatgaatttagtaaccttttcaaaattttactagtrtagtttctgtggtttttaagaatacaaatattttgccttctggtcttttttttcacacaagtatatggcagattcctataaatattttaatagatcagcagtttccaatgccatgtttcggtgatgatattttaccagagatagtctgtaatgaaaaattgagacaaatgatgacaatgtaatttgcagacatgtatacttatttataataaatttgtagacatgtatatttagttagttattcaacaaatattcagtgccttttatatcttaagaatggttcatgwtaattggaggcaaacaagaaaggcaaagttactgcttagttgaaatttacattctagtataaaaattgccatatttattattattattattattatacttaaagttctgggatacatgtgcagaatgtgcaggtttgttacataggcatacgcttgccatggtggtttgttgcacccatcaacccatcatctacattaggtatttctcctaatgctatccctccccgctccccccaccccacaacaggccctggtgtgtgatgttcccctccctgtgtccatgtgttctcactgttcaactcccactwatgagtaagaatatgcagtgtttgtttttctgttcctgtgttagtttgctgagaataatagctttcagcttcatccatgtccctgcaaaggacacaaactcaaccttttttatggttgcrtagtattttgtggtgtatatgtggcacattttctttatccattctatcattgatgggcatttgggttggatccaagtctttgctattgtgaatagtgctacaataaacatatgtgtgcatgtgtctttataatagagtgacttataatcctttgggtgtatacccagtaatgggattgctgggtcaaatggtatttctggttctagattcttgaggaatcgccgcactgtcttccacaatggttgaactaatttacactcccaacagtgtaaaagtgttcctatttctccacatcttctctagcatcttgtttcctgatgttttaatgatcgccattcaaaccggcgtgagatggtatctcattgtggttttgagttgcatttctctaatgaccagtgatgatgagttgcgtttctctaatgaccagtgatgatgattttctcatatgtttgttagccgcataatggtcatttctctaatgttagctgcataatgtcatttctctaatgaccagtgatgatgagttgcatttctctaatgaccagtgatgacgattttttcatatgtttgttagccacataaatgtcttcttttgtgaagtatctgctcatgtcctttgcccattttttgatgggattgtttttttcttgtaaatttgtttaggttccttgtagatcctggatattagccctttgtcagatggatagattgcaaaatttttctctcattctgtaggttgcctgttcactctgataatagtttcttttgctgtgcaaaagctctttagtttaattagatcctgttcatcaattttggattttgttgccattgcttttggtgttttaatcatgaagtttttgcccatgcctatgtcctgaatgatactgcgtcagttttcttccagagttttatggttttaggtcttatgtgtaagtctttaatccatcttgagttaatttttgtataaggtgtaaggaagaggtccagtttcagttttttgcatatggctagccagttttcccaacaccatttattaaatagggaatcttttccccattgyttgtttttgtcaggtttgtaaaaaatcagatagttgtagatgtgtggcattatttctgaggcctctgttctgttccattggtctatatatctgttttggtaccagtaccatgctgtttgggttactgtagccttgtagtatagtttgaagtcaggtagcttgttgcctccagctttgttctttttgcctaggattgtcttggctatacaggctctcttttggttccatatgaamtttaaagtagttttatctaattctgtgaagaaagtcaatrgtagcttgatggggatagcattgaatctataaattactttgggcagtatggccattttcatgatattgattcttcctatccatgagcatggaatgtttttccatttgtttgtatcctctcttatttccttgagcagtggtttgtagttctccttgaagacgtccttcacatcccttgtaagttgtattcctagggattttattctctttgtagccattgtgaatgggagttcactcatgatttggctctctgtttttctattattgatgtataggaatgcttgtggtttttaaacattgwttttgtattctgaaactttgctgaaattgcttatcaktttaaggagattttgggctgagaagatggggttttctaaatgtacaatcatgtcatctacaaacagagacaatttgacttcctcttttccaatttgaatatactttatttctttctcttgcctgattgccctggccagaacttccaatacaatgttgaataggagtggtgacagagggcatccttgtcttgtgccagttttcaaatgcttcctgtttttgcctattcagtatgatattgcctggggggttgccataaatgactcttattatttttggatacattccatcaataggtagtttattgagagcttttagcatgaartagcattgaattttatggaaggccttttctgcatctattgagacaatcatgttgtttttgtcattggttctgcttatgtgatggattacgtttattggtttgtgtatgttgaaccagccttgcatcccagggatgaggctgacttgatcgtggtggataagctttttgatgtgctgctggattcagtttgccagtattttattcaggatttttgcatcaatgttcatcagggttattagcctggcattttctttttttgttttgcctctgccaggttttgctatcaggatgatgctggcatcataaaatgagttagggagaagtacctctttttctgtcatttggaatggtttcagaaggaatggtaccagctcctctttgtacctctggtagaaatcggctgtgaatctgtctggtcttgggcttttcgattggtaggctattaattactgcctcartttcagaacttgttattggtctattcagggatttsacttcttcctggtttagtcttgggagggtgtatgtgtctaggagtttatcaatttcttctagattttctagtttatttgcgtagaggtgtttatagtattctctgatggtagtttgtatttctgtgggatcagtggtgatatccccttcatcatttttttattgtgtctatttgattcttctctcttttcttctttattagtctggctagtggtctatctattttttaatcttttcaaaaaaccagctcttggattcattgattttttaaagggtttttcatgtctctatctccttccgttctgctctgttcttagttatttcttgccttctgctagcttttgaatttgtttgctcttgcttctctagttcttttaactgtgatgttagggtgtctttcccactttctcctgtgggcatttagtgctataaatttccgtctacacactgctttagctgtgtcccagatattctggtacgctgtgtctttgttctcattggtttcaaagaacttatttatttctgccttcatttcattatttacccagtagtcattcaggagcaggttgttcaggttccatgtagttgtgtggctttgagtgagtttcttcatcctgagttctaatttgattgcactgtggtcaaagagactgttatgatttccattcctttgtgtttgctgaggagtgyttcacttccaattatgtggtcagttttagaataagtgagatgtggtgctgagaagaatgtawattctgttgatttggggtgtagagttctgtagatgtccattaagtctgcttagtccagagctgagttcaatggaatatccttgttaattttctgtcttgttgatctgyctaatgttgacagtcaggtattaaagtccccactattattgtgtgggagtctaagtctctttgtaggtctctaagaacttgctttatgaatctgggtgctcctcatattgggaatctggttgctccttgtatttggatgygtatatatttaggatagttaactcttcttgttgcattgatctctttaccattacataatgcccttctttgtctttatctttattgatttgaagtctgttttatcagagactaggattgcaacctctgctttttcttgctttccatatcttggtaaatattcctccatccctttattttgagcctgtgtgtgtctttgcacgtgagacgtgtctcctgaatacagcacaccaatgggtcttgactctttctccaatctgccagtctgtgtctttaattggggcatttagcccatttacatttaaggttaatattgttatatgtgaatttgatcctgtcattatgatgctagctggttattttgcctgttagttgatgcagtttcttcatagtgtcaatggtccttacaawttggtatgtttttgtggtggctgttaccaktttttcctttccatatttagtgcttccttcaggagctcttgtaaggcagacctggtggtggcaaaacctctcagcatttgtttgtctgtaaaggattctatttctccttcacttatgaagcttagtttggctggatatgtaattctgggttgaaaattcttttctttaagagtgttgaatattggcccccaatctcttctggcttgtagggtttctgcagagaattcctctgttagtcttggactttcttgaagaaatgggcttctctttgtgggcaacttgacctttctctctggctgcccttaacattttttcctttatttcaaccttggtgaatctgacgattgtgtgtcttggggttgctcttcttgaggattatctttatggtgttctctgtatttcctgaatttgaatgttggcctctcttgccaggttggggaagttctcctggataatatcctgaagagtgttttccaacttggttccattctccccgtgactttcaggtacactaatcaaatgtaagtttggtcttttcacgtagtcccatatttcttaggggctttgtttgttccttttcattcttttttctctaatctcgtcttcatgctttatttcattaagttgatcttcagtctctgatagtctttcttctgcctgatctattcagctgtcgatacttgtgtatgcttcgcaaagttctcatgcagtgtttttcagctccatcaggtctttatgttcttctgtaaagtggttattctagtaagcaattcctctaaccttttttcaagtttcttaccttccttgcattgggaggagcttgttattacccaccttctgaagcctaattctgtcaattcatcaaactcattmtccatccagttttgttcccttgctggtgaggagtttgtgatcctttggagragaagaggtgttctggtttttggaattttcaggctttttgcactgatttatcctcatctgtgtggatttatctacctttggtctttgatactggtgacctttggatggggtttttgtgtggatgtcctttttgttgatattgatgctattcctttctgtttgttagttttccttctaacaggcctctctactgcaggtctgcaggagtttgctggaggtccactcgagaccctgtttgtgtctacggccataccaccctgaatgcgcccgatctcgtctgatctcagaagctaagcagggtcgggcctggttatacttggatgggagaccctgtttgcctgggtatcaccagcagaggctgcagaacagcaaagattgttgcctgttccttcctctgaaaactttgtcccagagggacacctgccagatgccagctggagctctcttgtgtgaggtgtctgtcaacccctgctgggaggtttctcccagtcgagagggatggggatcagggagccacttgaggaggcagtctgtcccttagcagaacttgagcactgtgctaggagttctgctgctctcttcagagccggcaggaaggaatgtttaagtctgctgaagctgcacccccagctgccccttcccccgggtgctctgttccagggagatgggagttttatctataaacccctgcctggagctgctgcctttctttcagagatgccctgcccagagaggaggaatctagagaggcaatctgactacagcatctttgctgagctgtggtaggctctgccaagtacgaacttcttggtgctttatttacactgtgaggggaaaactgcctactgaagcctcagtaatggtggacacccctcccctaaccaagctagagtgtcccaggtggacttcagactgctatgctggcagcgagaatttcaagccagtggatcttagcytgctgggctccatgtgggtgggatccgctgagctagatcacttggctccctgactccagccccctttccaggggagtgaacagttctgtctcactggcattccaggtgccactggtatgaaaaaaaactcctgcagctagcttggtgtctgcccatatggtaaccagttttgtgcttcaagccatatttcttttattggaaaatatagaacttttccttctcacattcaacttcttgagaggatctctttgataatgtgttcatgtacacagttcacatcaaatatatataacatgtggatcaaagtgttaagatattcttctttacatatagtgttagtagctgacgatttttttttcttcaaaaataaatttggaaacttgtcagtccataatttttttaagtattattttactatctcatgaaatctgaaaggctagaatacactagataactcttgatttccactcctaccctgccatgaagtgataattcacatctggctataacttcataaaaggggcaggrcgacccacttcctaaaagaccactattgacttgaagacctgtgtctcttgtctcacttctaaaagtgatttaaaactcaataactcactctgaaatccactgtataagaaatagtaatgtttagggtcatttaaaagaaagattagtttaataaattttggcaccctgtttaacatataaaaccatgaccatgtgttaagtataaccatattttgtgcagaatgtgattcaaaagactgatttaatagctatagtccaagaagtgttgaaaactcttgcccagtttatggtttccaatataggacacatatcaacagaataagaaactcaagaattaaactgatgactgtgtcgacctctggaggaactcttttttaagacacaaagccaaattttcaccttcatttatgcacactcatctyctgaaggcttmcttatgcatttacgtgtgaaggaaggagaggatttgactcagtctctttgtctgtcatctttcttcctctctcattctgaaatagcttttcacagttgaggaaaaaataaagatttgaccttcccacagtgaatgataacaatgataacagctgatctttatatagtgtttattatatgacagagatcatttcatgcactttgcttctaagaactcatttattccttacaacactgtaagtactgttatccccattgcacagacaagaaaaatgagcttctgtattagtccattttcacactgctataaagaacttcctaagactgggtaatgtatagaggaaagaggtttaattgactcacagttctgcatggctagggaggcctcaggaaacgtacagttatgtggaagaggaagcaggcatatcttacatggtggcaggtgagagagagagagagtgtgtgaaggaggaactgtcaaacacttataaaaccatcagatctcgtgagaactcactcactatcacaaggttttttgcacagacaaaaccacccccatgatccaatcacctcccactaggtccctctctccacacatggggattatggggattacaattcgagatgagatttggatgtgggcacagccaaaacatatcaggtacaaacaaatagtggagttaaaaatcaaacatggaccatctgcctctgtagtccaggcccttaaccactacattatataacctcttgagagaggaaaacttagattgggcaatattagcatccaattgccagtgcaaaaggaaatggaagtcagcacaccagcttattacttacccgagatcaataagagacctgcaaatacttgactccgggttatagacttggtaaatccaaatgatttctctcatgaatccgaatccctgccagtaatgcagatattctaacttgagacttaccttccagactgaaaatgccaaatgagaaaaaccaagtaagtttgagtttctgcagttacaaagtgctatggtttgaatgtccctatcaaaactcaggttgaaataaaattgccattgtaatggtattaggagatggggcctttaacaggcgattaggccatgagggctctgccttcataaatacattaatgtcattattgcaggagtgggttagttatcacaggagtgggttagttattgtgggagagggttcctgataaaagcataaatttcacccccgtccactccatcttcagtgctcacttcatccttccaccttctgccatgggatcaccatccccagatgccagcatgatgttcttggacttcccagccccagaaccatgagccaaataacttctcttctttataaattgcccagttgatggtattctgttatagcagcagaaaacagacaagacataaaggaagacacataattaccctcccccaacagttcatgttacccctcaacattgttttagtcagtgcaagactaccaaagtataggtgtctgaacatcagggaaatgtaaatagagaaggtaaatgaattcaaccttccttttccctatactctcatttctgtcaaatataaaaacctgtgggttttacccttgttccagtttacataatcacattccaaattacttatgtggacttttatgagggctttttttctttacacctctctccttttctcatcagcctctgcaatcagctttatacaagagttatatttcattcatttcattttcttttctttctatttcacaagttctgggacttggctgtcaaccgaatcttgaacttggtaattaaattgttcataagctccaaacatgttgtaactcatgtcatattcatgtacacttctctgccccaacttgataaaatgagtgatactgggacaccattgtcatacacacctccaaacctgggtgtgtccacttcaaatgcctgaacttgctcaaatagaaatgggattactaaaacaactatatatcctcaccatgctggttttagtaggaaagatgcatcaaggataaagctctccagtgaaaagcatggggctgaaagaaggaagtctctctgaggcagaagtcctttggaaaaactgaagatgacgtcctagataattttgaagtcttatgtagcaacagaagtttatgtcattaatttagcaaatagtcatagacaaaacatgcaactttagagcaagtgccaggctgtgccaataattccacccttcacctccacatggggtcagtccatagaacaaaataccaaaggccttagtgctcaggtcttttgctcctgacattctcccttcatcctttccctatccccacttatccttttttaatgcactatagatgagtatgtcttaatttcttaagttaatttgcattggcattaagcacctactttatttatttcctttctcaacaactctcagactttgattcttcatgtccttccagggccctgccccatgccttctgctaaatgctaaagtcatgcaacagtttagtactgcgtagagtaggatggctagcaaaaggaaatctctcaaaggagcttcatgctctctgtgactcagggtagcagtatatggccttcggcacccactgtgggctgggctatggcagactttgcttgccctcattgctctctttgctttccttgatcttgcccctgtctgtcttcattttctcccttctcacttttttccctattgttacttacagtttaagttatggaagaaaaacacttaatgcttattggccactggaggatacacctcataacttggaaaatgaaaataaacactttaatagttttgtacttgatatgatgactcttttaaacaaaacactttttatctaggcatgaccttagatttatgggaaaagaaagttgcaaagatagtacagagagttcctgtatacctgtcttctagcttatgctaatgtggaaaacttacataagtgtggcacagttgtccaaaaaataaattcacattggtataattctattcactcaaattcagactttactcatatttcatcagttttttcattattatcctttttcttttcccagatctaattcagaataacacgtgtgttactacatgatgatttaaaatgtttacaaaaacaagacctctacctatgctcctattagtgtgtgtgtgtgtgtgtgtgtgtgtgtgtgctggtgtgtgtatatctttatttaataataaaactagaagggcaatgaattcgaaacggaggcttttcttactagcctttttaagatagacattgctgacacatggacagggattgaattagtacaaatattaaatatcattaagccttcttttttgagttctgtctgcacatcaacttcacctgaagaatgtttgtaaaatacacatgcttgttccccacccaaaatctattgaatcagaatctctagggagtgaggaccaacagttgygcttttaacacctccactccccccttgtattggacggtaaaggccagaaaagattaccttaggcattctcatttcagaagctaaaacagacattcaattttctataccctaatttgggacttatatctgagtgttaatatatgcatgtaatactttgtgatgaatgttaaatgtgttttaatagtgttcccttgcagaatattctttcctttgccggtattattaagactatcttgcattgggattcatgcccccaggcttacagttctctgagctatacttgcatacactgtcctcagtgaacctgggctttggatccagatcgccttgaattcaaaccctagatctgccacttaaagactcaagaaacttacataacctttttgtaattgttctctatctataataaatgaaaagtattactaattattacttacatgcaagattgttgtgagcgtaaaccacatgatgtgtggaaggtttggggcacagcattctttaccaattcagggtaaccctgaaaacttaggaaaaagagaggattcatataaatcacaaattttgcaaatgcattttaaatcctctctttgttccagctccttgtacagacaggactgcttgctactaagaatttccaacacaacctccaattaaatagttctttgatgtatagtgggtacagaagaagtccaacttatttgcatttgcagaatcaggagacccccccaaaaaatgctggaggtgtgaaagcaagaatcagaatttgtcaggattctccgtaaagtactagcggttttgtagatgctttgcagctgtggaactataaacactcaaccgcagacacctcattttatatctcttctatgtggtatatttcccttgtgaaaatgtgtatttttaaaattcactctgcaaaatgacagtcaatgttatcaaatatacatttatatgcccttgattgtaaaacccactacaaagtttattaccttaagtttaatagaaaacaattttgaaaaatgggaaaaaaatatatctgtcacagggaagtggttagaggttctaacagaggagatttcttgttagaataatttgttgtattttggttatacattttttgtttttctttcgaatgttgaaaaagttaagaatatattaatacatggacaggttagaaaatatgtaaataataggttggtcaaatcctgcagatgacaaatcatgagagtttgccaagctaaggggccctggccactcataccatccctttatctaactcttcctcctcatccagtcccataataaaaaatattaagcttgcacgtggtaccttctcttctaggctacttgttaatgggtcctcttaattggctatgtataaaataagattcccatgggcagaaatctttatctgatctgttcatggacatatccaagtgtcaactagattttggcacacagtagatgtttggtaaatatgtattgaatgaatgacagacactgtgctccacattgtaaacacatcatatcatttaatcattataacatccctatgctatcccctatgtgctattattagctccatggtacagacaataatcaggatagatcaggaaactaaccaaggttacacggacagtacctagatggcaggaggccccaaagcatgtgtactaagcattatggcacactgccttcctgtctggcattcttgggacatgcatgtgtgagcgataaggtaagtccaggaaagcgtggggcactgggagaatgtagaagtagggatgatggaatttcatttccacagtgagagccccccatcctgctcccattgtcagacccgcactttttgttatctcttttccttctgtcttgctacgtttgctttgtcttcttcctcgatagtttcccaaagactttaaacgactaactatcaaagaagagaatatatgtgaagtcactagttacttttctgctcaattagctatatatagattaactttttaaaaaaatattttccccatacacccactcacataactgtgaagcttaggaaaaatttcaagattatcgtgggtgggccccatataaatccccacactgtcaattctcccagcagctgtttcttaattcgtcatcagtgtagaaatctaaatcagcactcagtgaaatctaaaagtccaaaagatttatttcaaatttcaaacctcctccctaatgttctgaggctgtgtcaacacaggtagagagacggggagagctgagggtatttaagaatcacataatgtgagaaactgaggagaccctagggatcttttagccctaccccctcatttacacataaggaaatgggatctgaggccaacagcaaacttgcctgcctgctatctgggaagttctattaataacacactgtcatgggggaaaaaattcatacaggtaataaaggtttgttattttcaaagattaacattctttattaattaccacttttttgaaactgacacagccacaaaaaactcctgtataagaagaatttgtctaataaattgtatgattgtttattgggtatctgtttattttcttaatttttaattgtctgtcaatccttcttgatttaaagtagtcacataaatatataaatgtaaagagttaatataactaattgaattcatttgagggaaaaaaattaaattttctttttaaaaaaagaaagaaaacattaaagacagaggtaacattagcacaaaaaaatgtgtataatcaaagtctagagggaggcctaaatgtaaatcaagctttctagtaagcaaaaacaaaagagaaaacctggttaactccaaggttcagaattgctgtgatatgcagacaaaccagctgtgaagacactgcacaacagtctatgataaaaagacgggagggacatttcttgtttgtatagcaaaggtctacaatttgcaatgcactgtggtaaaacagaaaccataagctgaatgcttttgtcactgaacttatattttagttagaaaagacataagaaactaattgtggcatttaacttataatttagttagaaaagactaaaaaagctaactgtggcatgaatgagaaagaaattactgctctattagtggttccaatactgtgaggccacaggaaaaaaaaaaaggattctgaaagatacggtttggaaagacttcgtggaggaagtggcatatcaacagggacttgaaggctgcctagatatgcaaagaaaaagttcaacggaaatacaggatgaaagaattgggtggtcaaaggaacaaacccacttgctgatagattgtcaaaaagtatagtgtctgcactactatgtgacgatgacattttttttccctttgtcatctaaaattgctatcaggccgggtgcagtgactcacgcctgtaatccaagcactgtgggaggccaaggcaggaggattgcttgtgtccaggagtttaagacaacctggcaaatatggtgagacctctctacagaaaaaattttaaattatctaagcatagtggtgtacacctatagtcccagctactcaggaggctcagataggaagatctcttgatcccaggaggtggtggctgcagtgagccaagattgtaccactgcactccagcctgggcaacagagagagaccctatctaaaaaagaattaattaattaaaaaaataatattgctgtcagtaaagactgactagtctgtgtgatatttatcatagctatatttcataactccagtgacctttttaaataaaaagtaaggtccagttgaccctccctgtctgtaggttctgcatacattcaaccaaccatgggtcaaaaatattcagaaaaaaaaatttaaaaatacaataaaaactaatgtaggctgggtgggtgcaatagctcacacctataatccttgcaatttgggaggctgtggctagaggatcacttgagctcaggagttttaggtcagcctggcaacatggtgagaacctgtgtctactaaaagtttaaaaaattagctgggtttggtggcatgcatctgtagacccagctactggggaggctgagatgggaggatcacttgatcctaggaggtggaggctatagtgagccatgattgcaccgctgcactccaacctgggtgacagaatgagaccctgtctttaaaaaaataataaaaataaaaatcaatacaatataacaactatttagatagcatttatgttatattaggtattacaagtaatctagagatgatttaaaatataggaaagaatgtatgtagcttataggcaaatactacgccgttttacatcagggacttgagcatttgcagattttggtatccttggggggtcctggaaccaatactttgaggatactaagagatgattgtccattaaaaatgttttaccataaaggaaacattttatctcttctgtgtcagtctgtgaccttttgggtggaatctgaacaatgtgtaaatgatagtttcccaacagtgtgcgctgatgtgtaggagtagaaaatgatcctttggttttcatataaaaactttcttatgaaacatgaagctaacaaccaagaagattaatcccaccagtgagacacaaggaatgcttaattttggaagtgaagctacttcctcatccctgaggcagcacatacactttttcaataatcctttatttaacaagatccaagaatattaatatctaacagcttagcctaaatttcttgaaaggaccaagcccattgtgttgtctcctgacttgattttcccaaactgtcatggattttctatctaaggaagatgagttccttagttctgggaaaacaccattgaggaaggatgcttcagaagaggaagggatgtcagccagggcagataaaattagcaagaaatattaagattaagtgctatctaagaggtacaaaaaataatagtgtttcacctcaatagaatcttattgttaaaaatacagtgtatctacagttytgaagattatcaaaacacaatattctagccccaaaacaggaaaagaataatgattcttaagaaaaaattctttctgggctgggtagggtggctcatgcctgtcatcccagcactttggaaggctgaggtgggtggatcatgaggtcaggagatcgaaatcatcctggctaacccagtaaaaccacgtctctactaaaaatacaaaaaaaaaaaaaaaaaaaattagccagacgtggtggcacatgcctgtaatcccagctactcaggaggctgaggcaggagaatcacttgaacctgggaggcggaggtggcagtgagccaagattgcgccactgcactccagcctgggtgacagagccagactccatctcaaaaaaagaaagaaagaaaaaaagaaagagagagagaaagagagagaaaggaaggaaggaaggagggaaggaaggaaggaaggagaaagaaggaaggaaggagaaagaaggaaggagaaagaaggaaggaaggagaaagaaggaaggaaggaaggaaggaaaaatattctttccatccattacacactgtaatgtaaaatgatgtgtcccagacaatggtctgtaaaccacattttgtaattccattgtaaaagataatgtagtgcgagcaaggccaaaaatccactattctttggaaaagtgtgccatttaattccactgaagataaggcagttggcacaagtcaacttttccccctggcttagatgtagttgtgcctttcaaaatgagctctctcatttgccaaatacaaagaagagaatagtgttttctcagaggaccacaggatatcaaacataattaaaaataaaagtaagattccctttgaatctagaagaaaactcacccaaatttcttgtaccaaatgaaggtatactgcagattttatcacagtcattaccatgagcagtcaataattccctgaatccctgttggacagaattacatcaggtacatgtgttgtgatgttttctgttttgagttctgtttgttttttatttattggtaattcagataatctcagtttcaggaatttgttttcttctctcctaaaatggagctgatgttcatctcttccttatgttatacctrtatttatgcaccaatttcatagaaaaccatcgtgcattttcccatggaattttgggtgacagtttaagatcagcgtttactataatgggcagacttaaaatggtccccgtgatccctgactcctgaagttcactcccttgtatgcttccccctctttgaatgtcagcggacctttaacctagagaatacagcagagttggccagatatatgtgattccatggttatcttatgtaagattggagtgcatgtcttgctagagtcttttacttccttattgactttgaggcaccaaggggccatattggggaaccccacatggcagcctccaactgagccaccaaagaagtgaattctgccaacaatctgaaggagcctgaaagcacagccttccctggttgagcctcaaatgagactgcagccctagccagtactttgattacagctttatgagatcctaagtaaagaaacaagcataactgagtcaggattcctaagccacataacccgtgagataataaatgtgtgttttaagtggctgtatttgttatacagaaataaaaaatgaacatacttactaaaaaagtttttagctgttgtgagtcctggtaattggatttgttttccagtgatatccatggacactgtgtcaatagtgatgattgatgctgatttgttttactcttatttattcaggatctgggtattaaaaataaattcaaactttcaacaggctgatcacctctgcccctctccctattagcatgtgcatgtgtgtgtgtgtccatgtgtccatacatgagtgaatggatgtgtatttaagcttaatcatgacacagggggttgtttatacagggtttttagaaaacaaaaacattgtctctatgaggcagttccttagaagccaactctcaacagtgtctcagtgtttccctcctgtaatttttccacacattatgcactggattttagtttgtgatactcaggattagtcatgaaaccaagtctttttgtgttctatggtttgaccagccctgtgcaagtctccagggaagcacgaaggacgggtaaatcagagtcccatcccttgaagcatggtggtattagaacatcacttaaagaacagggatacattacccatttagtgaaataatctagaagtcctggaaactaacttagctcacaagatgatattcattagccaatttacttcagaaactttaagaaaatcactttacctcctctgtacattcctccttccctccttccctctcttttcctctctccctccctccttccctcccttctttccttccttccccatattgttattaaatatgctcattattagaatagtatcaaagacactgaggcatttttagatatcttgtgaaatactccttatttttgtctcttcctttagatatcttaattatcaaaataatctaataagactctatttggaaataaagtgaaggagggtaaagttgtgtttttaaataggctgatcagtgctagaaataataggatagttttaaattctagcaattatagatcaaggctccatatactatttctaaaaagtctgtgaacccctgggaattgtgaatgtttcccattacatcctgccaacgattcttattaacctattggtgacgtctttcccagaggtgaagctttgatctgcttgtcatctcacattctgtctcaccacagtctagagcttccaggtccatggggaacaaggatggggcagcagcttccctgtgccaggactgactgggaaattccagaattctatgaccaggtacctgggaagggagaagagctctctgagttacagttagtctgggagcttttgaagtgaaactgtcatagggaaagtgaaggaatttgctttgtgcaatcatcatgccatagtctgacaagacaatggaaaaagaaagaaggaattttctctcaagatgtcaaataattagctgagtcatgaatgcaagcaggtaggcagaaaacagatatttgtagagaacttatttctctttctcctaatgaagtttttgaacaacaacgataaaatggaccttttgcctaagaagcaatttaacaaccattgcttcagtaacacgagaaccaatgtgattagagtgcttgtgctctgtcccctcataaatggttagtattgaggccttataaagaaatataacatctgctttttatacataaatacctacacgtaaccatccacaaataacttacgaatacccataataaacacagaatccatcattatgttaaatgccactgtgattctgagcattttaatatgctgtgaaggcatcagagtaaaacagaaacaagttatatctaaataggaatgcccagtacatttaaagtaatgagacgttttgctaaattcatatgttagcaatatgtcatgtggagtcatgaaggatcagaaataaaaaacagtaattgtccaagccgtcaaggagggatcagaagcaggctttgatcccaggctctgagtagagttgctgtggaattgtagattacatagaatacaggtggcatcaccacagattcctgtttatgtatttaacttgtaacttctcattctgacatcacaggaatatttttccttaacaaagtgaaataaaaagtaaataagctctttaatattgggacataaccaaatcagagggcaacacaaatttacatgggtacttgtgaggcaaaagaaagaaaattcaaaattcacttctaaaaatggacattgtttaaagcacatttaataagtgttacagagtgatgtttcactgtcacctttaaataccccttactgtttctttgggattaccaatttcaacatgaaggtccgagtgaactttgctagaggtgatttgcacaggctcatatgcatctcttcctcatattcagtgacctcacattagcagctttaaattggccatgttgagaacattgacaccacagaaattggcaaaaactagaaatcaagtaacacatgctacaagtctttttttttcttttctcccttcttggaaaattgtaatccagttgttaaatatttatcattataaagtagatccttgttaaaaatattctaatcctcaccaatggttttattttctttctgcctctcttctgctgcccctaaattaaagtaggtctttttatttggggctaagactagttccatcaaaatataaaatagatgaaaagtgttttggggcctttttgccctcttttcctagaccttttctgtttctcctcttgtcaaaatctcacttttttcctttaccttttcagccctgcttcagccctaggtcttcctaaaccagagaattttccaaaaactgcgtgaatatatatgccacaggctgaaatagtcttcccaaaaattagtcattaaaaaagtagagaaagaagatataagttttacatgaaaccctatatagataggagttccttcgagtattttcaaacttgattaacaacagagtaaattatttaagaatgatttaagaaatcaaagtatgagaacttggggctgatccaaagatgtggggattcagagatgaggggcaggcatagaagaggagaagagactgagtatttgtcaccacgtaaattcctgggcgagttgggtaaattttttattataagaaaacactcctttttcttctatataaaatttttttcaagtgagttgctaagttcattgtgagtcatgcattcctttgttcaagtgtggacaaatggtccttattttgttggaattttacactggcagagatcaatggtacaacctggtgaaccccccacaccaaagacacacaggtgtacttaaaggctgatcttctacagtacgcatctatggactggctttggggtgtgttcccaaacactcagagccaccttgagctggggaactggttagtacaagtctctttatgtgtcccttactctacaatcatgcacctagggtcgtgcaaacatcctgaaaccaacccaagctctaggagtcagaaaaggccctgaatgcatcttcaatacaggatctgtgcacacagcatggcctgcttctagaaaaccaatggggctcagaggcagtccagacagaggccttattttaagggctgatagaataggctgtgtttccccaacagcctaccttggtgagtaaacaccaacaattaattcatttatttactcactcaggttagaacattgtgttttcaagtttctaatattaaatttctttttcttttttctggaatagggactatcttattcagctcaaaataccatagactgaggcttaaacaaagacatttgtttcccaccattctggaggctggaagtccaaggtcagggtgccagcctgcatggcgagggttctggtgagaactttcttcttggcttgcagatggcagccttctccctgttcccttacttggcagagagacagagtgagccctggcatcttcctcttcttataaggatgctatattccatcatgggggcccaaccctcatgtgcttatttaaacctaattacttcccaaagaccccacctccaaatatcaacacattgggagttagggcttcaacccatgaattggtagaagggcgggaggtggacacaaacgttccatccataattctagctggtaacatcattgttagaatcagttgccttgccagtctcagaaaacaggacactgagatgcaaagacatgtacatttccatttgaggcaggtgccaggagacaactgagaggacactgagtttagaacattggatcaggcattgagagggaatctgggttgctggatgcaagaggctagtaaggggtgatgagagttcttcacataaatcaacctataactcacccagcctctgtgtcccaggggcctatccattattgatcaaaatgtcagtagaccttttgggttgtgtttcaaagagtaaccattatcttagagattcatagcaaaatatgagtggttcccagtaaaataaatcagagtttcctttatcttagctagaaacacctattgggacttttgtcaaattatttaggggaagaagaaggttgaaagcaaacttccaattgaaaagaagcatatttattgaagttcagagggctggagcgttgttttttgattgacaaaataatgaactctctgataagagtccagaattagttggctgaatttgtattcatttctccataaatttgccaaagttagaagagaaaatccatagaggccaaatgaagaaccatttgattaagcgtgttatcagcctggttgtggccaaattccacctcatatattcatgcacacattctttgctatgagttgcatatgtgctttgtggttgtgggcagatttaggtttgtttttctttctgagtcttttctggtccaaaagctcatcatttaaagttttggaagcaatttagaaagctattagattcccaaccccctcccgacttttggaacacttgcagttatttttttctggcacaaaaacaatcaaaaaggaaaaaaatgtcaggatatcttccaaagagagacataaaggtaacattttatttataccatgatttgtttattcttatttgttgttaccataaaagttatttaatttttttgaactgaaaggcagatgattttaggggataaaaaacctaaaataagaagtgttgctatgtgattacagagaatagttgcttttgttctgcctgtgtttaattaaagcaccatttgagaaattcaagaatcaggtggtaccgttgagtcactggacacatttttaagcaccatcttgaaatgtgatataaattgattttaaattttaaatttgtaatcatacacttcctctaaattgggaatcatgagagcatttctttttaagtagtttgtgataattttggaatttgaaagaaactttaaaggtaatgtatttaaagttactcacagaaatatgctggatgtgttgactggtaactttaaacatgtttatattgctatttttctagcacttgaaaagtaatcatgttttatagccaaagtcatctcctgtccatagaacaattaatagtcataattgatagttttatgcatgaaaattaagtattgctcctgcaaaactgaggagttaatgtctttacgtgctttttcacaaacattccttataatggaacaccaaatgcctacaatttgaacacatggctggtggaaaaaaagaagaaaaagaaaatcaatcctaagccagaaatctgaaaaaagrcagtgactttgggtcattttgtaatcatctttggtgcttcagtgactaaaaaatacatgcagagtgcaagagcaccttgctgaatcctacaccctgccctccttgtgcagttatgttacatgcaactccaaagcctccacagctgttgtctctactctccattcaaaacaatgcacgtgcaactttcccttgtggctggcttcgtcctccacacaccaatgctttgtgtgaaaaggtttcattaaaattgagtttagggtaagtacgggataggtggagaaaagattttcttctaatgcttctccagaccacactgtttagccttcaggagacccaggaattgatatgagcaaaatgtttttacacatgaactgttctttaatcccttttttgcttcttcaatccttgaacttcattccctttcttttcattaacatttacaacacacactttacagggaaagaaagtgaaagatatgtaatgattctgcctgctacatctgactgtactccatttctcacattctatcctcatctttttctagccacctgagtcttcagacagttttaccatcttccctattttaaccccaatttaaacatccacaggaagccaaacaaaatatgcccatctgctccagatgtgtcaaatcaagttctgctattttaatttttttccaggcaaaccctccaacaaatgtataaacaggttgctttttagaagaagtaaagattaatgtctctctgggaaaaaaaaatcccatgcattttggaaagtctggctgttttccccttcaaaaaacttcatgtaaactaaatgcatggcttgatcctcccatgtaccagaaggggagcagcatctttgagctctcttcccaaatcctctgcttggtctgggcgtatcctgtgaatgaggagagaatctaccccacagccagatgcttgcatttggccacagttcatttccaggcagcctggaagagagcatcccacaacattgaacagaggcagccaagatactgtcgggtgatcaggacagctcccgcctctgtgttcctgtggagcctccttcctctccaaggaatttgtcgcatgggactgcataattcagttgtccattcagtcaacagtgatttactaacaacctactttgtgttaggcactgttccagggtctgcgcattcagcagtgagcaaaataacacaaaatgcttgctctcatgaacctggagacagacggtaagaatatacagcrataggcaacatggtaggtggggatgagtgctctgaattaaaataaggcaggacacagagatggagagtgacctggacaggacagggttggcagctcagaagtgcattatctacagtggtcagggaagcctctccagtgaaaggacattaagacggagctgaaggaagggagagagtggatgaaagagcaaaatccctggaactgggacatgcttggcaggttgagtgtccacaagagccccaattaactacaggagggtgagcaaggagagagtagagggagttgaggttagagaagtaaccgtacgtcaaattatggaggactgagtttctcaaactccagtgtctgcgcaaatcccccagggatcttgtgaaacsacaggccttgatttagaagatctgcggcaggcccagggtctgcattcctaccatgcccccagatgatgcccctgcctctaccgttccccagaccatgctttgagtagcagagatgaaggccttcttgcccacagtacaaattctgctatttctttcctgttaatttgaattggtatgcaacaactgtacatatttatgggataagagtgatatttcagtgcatgtatacagtgtgtaatgatcaaatcagggtagttagcatatccttcactgtgaacatttatcatttcttcatgttgtgaacattcaaaatcctctcttctagccttctgaaaagataccccagagtattgttaaccatattcaccctacagtgccacagagcactagaattcattcaccctatctagctgtaactttgtatctattaaccaaactcttttcatctttcactctcccatacccctccctgcctctaatgactacaggtctatctctgtttctctgagttcaatttattttagcttctacatatgagtaagaacatgtggtatttgtctttctctggctggcttattttagttaacatgatgttcttcaagctgatccatgtttgctgcaaatggcagaatttcattcttttttacagctgaatagtattccattgtggatatgtaccacattttcttcatccatccatctattgatggacacttagattaaaggtactctgcttttactatgagtgaagtggaaattttttgaggcttttctttttatgagacaggatctcattctgtcccccaggctggagtgcaatgtcacaatcataattcactgcagcctccactcccagggcacaaatgaccttctgcctgagcctactgagtagctaggactacaggtatgcaccaccacaccctgccaatgttatattttttgtagaggaaggttctccctgtgttgatgaggctgctttggatgcttttaaatagwggggaaataggatcagactcatttttagggagcccctctggctgctctgtgaaaayagggcaagggaggaaataggagacctcctgggagataactggagtagtctgggtgagatacttcagtgccagcatctaaggtacttgcaggtgggacagccacaacgaatgccacttcaagtgaatgtgaggatcagctctgctgcccaygtggaaacataagtaaggttgttacctgtggccttgcagaagcctgcaagtcaaaggccttttgatggttggtgaaaatcacatctgatatgcgtgattccaggaagctcatctgcctcattcctgaatttaatttctatccatgaygcacatattactattgcattaaacgtgaagtcattgcctcctgccattgtaatgtatgcatgctattgcagaggaaatgtttttatctacctcccaaataagtaagcataacttgagctcgcattacaaaatgacacaataaactaaaaaggaattcatttaatatttttaaacatgattttggtgtccttatatttagggaaatattttattgtaagttcatcttacaataaaatttataagggaaagatattttattgtaagttcatctcaggacaagaaacttcacttggcatagaaattaacatccaatctgcagcctgtcattgtagtgagatagtcttgaattccctagctaagttatttacctaaacaaagtcttgttcactttgaatttcctagctaagttttttacctaaacaatcattatatatgtttcaaaatatttaaatttttcccttccctctgattttataattttcttgataaaccttcctaaatatctttaaatttcactgatctaatggttcttaaccaggggtgattttgccccccatcaagggatatttaacaatatctggtgacatttttaactatcgggagttgggggatgctactggtatgcagttggcagaggccggggatggttaagcattctgcatacctgggagggccttccataacagaggatcgttcattccaaaatgtcagtagtgccacatttgagaaaccctggccttctggtgaccacaaggccttcagctacagaaaataaaattcaccaaagatccccacagccatgctttgaaatccttcacagtttgcactgagccatgcttcccacaggctgctccaatgaaggggattactctgaaggccagctttggctcctggattctccaacatccgtgccaaacctttcttatgcagcacagtagcctcagacatttccagctcactcccacttttctctcaggacatttttcctataaaattcttgcacatttaatctcatttagaatctgtttctcagagatcctggattaatatatcatggcattaaatcattgaaaataatgaattaatgatctttcctcattgtagtgatatgggaagaaaacgttctgatacacagaacacagaaatggctcagaaatgagaaactgactgactactaaattgttagtaaaagcaacagaataagtaagtgaaaaatagagcaatttggggggaaaaaaagttgagaaaccccaatcttcaaaaaaaggataaaagtcttagcttttgttcatgtgttatttaaaacccaactcaggcctcaactgaaacaactaaaattaggaaccaaaattgcatcccctgcccattcacacttttggaaccagagtggttctggacatagtcatgaggtcatcattcctaattagagtaggaatttcaattcttgggtttctaacccaaatctcgctatcctcagaaagcttgacagtatttgcagctctgcccattagatgagatctaccctttgcctttggtcaggaagagtcctatgtatggacacatcaccacagaccactcagattccctcttaccttccctaggacactctgcctcccttcctcctttccatgatactcatcactctgggtagactctgcccaggcaacaattgccctctgtggtttgccaagacccatcctgctttctgggaatagatgagtccctctaaagatgggcatgtccccagccacccaccactgtgcaggtggcagctgacgtctattgtcctgcaactcacatatcctgatctctgctctgttatgaactccagccagagaaatatacagatcttattcctgattcataagagactgtgtttgccttggatttaaccaggtctgatgactttcaggatttattatgttgatgaataaagggaaattctctcccttaaactaacacaatgatctctctgaatcagattctccctatacgcagccagcaatactagagaagccccagagacgctgctacttgagggctggcctaccgcagagctggcgtttatgttgtgatgataaacattcttgaaaaaaccctgaaggagatcctggcattttcctagtgcctttatgtgccataccgagtgcaagctgcttttcatgtactaactaatttaattcctgcaagagtcctgtggcatgggtatttcttattcccattttactgacaaggacactgaggctcaaaaagttgtttttttgttttgttttgtttttgagacggagtctcactctgtcgccaggctggagtgcagtggtgtgatctcagctcactgcaacctcagactctctggttcaagcaattctcctgcctcagcctcccaagtagctgggattacaggcacgtgccaccacatccagctgatttttatatttttagtagagatggggtttcactatgttggccagaatggtctcgatctcctgatctcatgatccacccaccttggcctccgaaagtgctgggattacaggcgtgagccaccacgcccggccaaggctcagaaagtttaagtgacttgcccaatatcacaatgttagtaagtggtagaggtataatttggattttatttgaattggaaaaggctgtgatctttctaggtgatattctaggtaacactagtttccagcaggcactctccattacctgcgtctgttaggtctgagtctgctatggttttctgactgatgtgtagggtaacacaattaaggaactctccactggaaggccaagtctccactcaggcacgtaggtagctggcagtcctccttgattctgctagccagagccagcttattgaaaacaaaagcagtctgttaggacagtgcccagacttctgacttcactacggaggctaggaaccaagtcaatatcatcagtcattactttccatcaacctctatcatttacatgcagtaggtgctcagtaaatgctgataaattcctgtatgaataataaatgaatgaacaaacaagagcatttgtctgtacaagttacagagttttagaatagaatgtaagtgtgaagctcgataaattcaaacttctgcaatatccccaccaagtggttatctaaattccgtttgacttcccttggcagggaatacgcacgcacactttctaaaggagtttttccacttcatatgactctggctgttcagaaggaatcactaattaaatgagatctttgaaaaaagtcaagaaactggaaataagtaggaattgctttacctgatgcttatcagcttacaggctttactgctccaaaaatttggttcgatttgaaaacattatgctaagtgaaataagccacacacaaaagggcaattattgtatgattccttttatatgaggtacctagaataggcaaattcatagagagagaaactagaatggagattcccaggggccgtagagggagagtagttattgctgaatgtgtttggggtttcagtatgtggtgaaaaattctggatacagatgctcacatgtcattgtgggtgtctttcatgcaactgaattaggttttttttttgtttttgtttttgtttttttttttcagataaaccatgaatcacattttatttattttgtcctttcatttttttttttttttttttttttgagacagagtcttgctctgttgccaggctggagtgcatggtatgatctcggctcactgcaacctccacctcctgggttcatgctattctcctgcctcagcctcccgagtagctgggattacaggtgcccaccatgatgctcagctaattttttgtatttttagtagagacggggtttcaccgtgttagccaggttggtctcgatctcctgacctcgtgatccacccacctcggcctcccaaagtgctgggattacaggcatgagcctcaacttttattttacgttcagatggcacatgtgcaggtttgttacatgggtaaattgcatgttactggggtttggtgtacaaattattttgttacccaggtggtgagcatagcatagtacccaataggtagtttttccctttttttttttttttttttttttttttgagacagaatctcgctctgtcgctcaggctggggtgcagtggtgcratctcagctcactgcaacctccgctcctgagttcaagcgattccccctgcctcagcctcctgagtagttgggatgacaggcacctgccaccaggcccccataatttttgtatttttagtagagatggggtttcaccatgttggccaggctggtctcgaactcctgacctcaggtgatctgcctgcctcagcctcccaaagtacttggattacagccacgagccatggcacccggctggtagtttttcttcctcatcctcctcccaacctccaacctcaagtagcctccccccaacagtgtctattgttcccttctttgtccccatgtgtacttagtgtttagctcccacttattaagtgagaacatgcagtatttggttctctgttcttgcattaattcgtttagacatggcccctccagctgcatctatgttgagcaattaaaaaaggttaagatgagctaagtgaggtggtatgcatctgtagtaccagctactcaggacrctgaggcaggaggatcacttgagcccaggagttcaaagccagcctgggcaacatagtgagaccccccccatctcttttaaaaaatatttcagatgataaattttatgctgtatgtattttaccataatacaaaattggttgaagaggagtacatataaacacaacaacgaagtgtttaactcatcaatttcagatacacagtaaaagaatgtatatgagaattggtcaaggacattctgaggctttaagcttcaagtcaagaaaaacaactgcctttctgaaaacttacaccgctcacagagtctggtgggctatgaatttgatggtacaacttctaacttgacagtgtggagatcaagggtataggaawggtaaaaagctttgaaaagtttgagagtggagtttgcacagctggacacagggcaccacaaacacaggtggtgcatttgtgcctttggtggacaaagtatcacccacaatgcacaggcgcttccctggctggacaataggtctctctctccatcccctctctctctgtttcaagagaagacattttacgtaggaccttccactctgaatatgaagggtatatcatttccctctcaaatccagactcctctagttgaatggctgacagccaacagaaggggtgtatgcacccttcattaggccagatttactgtccgccttccatgagtggttcagcatgctctctgtccagctgtggctcctgcctgcaaagcgtgccatcagcttcctggttcagagagagctaattttctctaattgcttccaatgagaggtgggaggcaggagggtatgtgccccattcagagccgctgttctcatcagcctcaccaagcagtgagagcagctttcacattcaaggtcttctttccattatttgggtaaaaatgttttgtctcataacctgggatttaagaatcttcaacaggttgcttaacccttaaagatctgacccacctggcctttaatagatttaaagactttatttggttttatgatttttaaaggaatcataattcctacttatttaagaactttaattcctatataagaataatttattctcattcatacttgtaaaaaaagtgtatccattgttttagaaaaggggaaaatagaagacaggttaaaaaagaaaactaaaaggcatttggtgttgcttagatgtacatgttttgtagtatatatatgtggttttgatcataaataatgtatcaaagacatataataccaatttctgttcttttttctgaaatcttagaattgagtccttagaagaaataccaagctaaagggcatgtgaatttctaagtttcctggcacttaattccaaattgttattccaatttctagtgtgccatactacatctttattagcattcaggattatcttcttggttaatatagtaaaatatcattttgttgtttgaattttcattgctttgataattgatgrtatttaaagatgtttaggctctttttttctttttcatttgctcagcttttctgaaaacctttaggagacaagtttctcccaaattttttctactgagatttatgcattactgatatgacttctaacatataagctagttaacatcaagaggattagtctatcacaccacttgtcacctggggcaaggtagtatccagttcattagggtaaaggtcaagtaagtgttttgtttgtttaaaggggaacacgggtaggagttatcccaaagttagaacgcaatgaaacccaactatatagtaaaatayatttggggctcaactctgttagccatcaaaggtagtacaaaacatcagaagatgaagagggttttgaaagaaagaagggccatgtcagattaagaggtagaggaacatcaagataatttttcttctattagagtttctcttttagggtttctattagagtttctctaatagggggtagagaaacagcaagataattttttttctattagaatttctccattagagtttctcacctgcaaggtgttgactttccagttacctggcatttcattctactttttggaatggcctgagctgaaattaatcaggctctgttgatgatgcatccaccagggtttcccaktggatgcttagaaaaaattccatcacagaatatctgtgtcttgtcttcttgggggctaggagatcccccaaatttttctcttctgttcttgtttgataaaggatgtgtggaggacctggtgcttragagtttcagtttgacataaaggtactagttctggagagtctcttgggccactttatgttaacaaagactctcttgatcagcctttagttaagcttctctgagctctctccttgactaggcttcaaccttgggcttctgtgtcagtccttgtggagtctggttttagcaagaatcttgcaaagtcagtttagagagaataccccaccttttatatctgatcaatttcctcaatccccacctgtaatgtataagcccttgacctgccttgagtagaaatctcctacccttcatgtctcctcctagtaattttccatccactgaccccacactctgctctttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttmcttmcttccttccttccttccttccttmtttcyttccacagaatctcgctctgtcacccaggctagagtgcagcggtataatcaaggctcacagcagcctsggccttccaggctcawgtgatcctcccagctcagcctcccgagtagctgggaccacaggcacatatcagcacgcttggctaattcttttttgccttttgtttgtttgtttgtttgtagagacaaagtttcactatattgcccaggctggtctcaaactgctgggctcaagcaatcctcttgcttcaaggtcccaaagtactgggattacaggcatgagccactgcacccagcctcacaattttttctttaacaatgcccagagcatatgctgagcttcccgtcactctctggggcggaatggaatattacacaactggcacggtaaagaatgcacttggttttggtggtggataacattttcctttgcacctgaagcacttccacaaatagcccatttgtcctccttgcaattaaattagaaaaactgtctctaagcttggtttgacctatctgtagctctttgaaaagactgcttgatctttcctcactctccgtgtacctaaatcttgttcaggctctgtccagaaatcaataggaaacataaaaccttgaagcattataaaatcaggcattctaaactggaaagggcctttgattatttagcccaaatgcatcacctgttttacagacgagcaacctgaagttcggagagstggaacttcctccaggtcatctgctgcactggtgatagaggcaggactaaacactctcggtgcagtgttccttctctgagtcatgttgactactatatgctcattcacagtcacaaactaaaaatctcagacaagtcaaaagcatacaattacaggaccagaagactcctcagtgattatctgggagtccaggcatccaagggacttgaccaagtttttgcagctattgctggtagaccaagtacggaaatacacttctcttgactctcagtctagtgctcctttccctgcagtactctgtgcaataccaaaagatatggatctccaggattggctgaggttagcaattaatatggtatttttagtcatgtctacttggagtagggggtgctgatttttgtttcatgtgtgttcttgagactttttgatgaggttccgtatgcctcactctaggtgatgtttttattagtaccatgttgtcttcctataaagagtttttatggcgaacagaaagctgtctggattcttgctatggttgtaggcaggagggaacatggtgtgtggcttctgaacaaactctggctgctctttaagttcaatgaagtgaaaaaaaggcaagttaattgactacagacatatgcaagagagctctcaattgagccataagatcttttggratgtgggtgtttacaaggtagctataagcactctcataagtactgcacctgtgaatcatggactttcattgtacatagctttccactgcttgcttcttgaggctactgttcagcccatcagtaatttttaaagatcctttagaaagttatatagaggaatgcaaatgtgagtaaacaaggcgcctctacctactgatggcatcttcaatatttacattggcccgttgagttttatcagctggatattgctataaaacacatcacctgaaaattaagtggtttgaaataatgagtatttgtagttgttcacaaacctgtgggtcagctgggcggtgctgcagatctgaaccaggtgtggctgatcttgaatgggctctttcctgctgcggaaggcagccagcaaggtaggtgggggctgatggtcagggatggcctcactcctatgttttcccattggctgactatcagccagggctgcagtgatgactggtgaaatagtttggatatttgtccactctaaatctcatgatgaaacttgatccctacagttataggtggggcttaataggaggtgtgtgggtcatgggggcagatctatgatagatggcttggtgccattctggcaggatccagtgagttctcactcttagttcttgagagatctggctgtaaaaaagaacctggcaccttcctctcctctctttcttcctttctgtctggccatatgatgcctgctaccctttaccttccaccatgagtagaagtttcctggccgggcacggtggctcacgcctgtaatcctaacacttagaggccgaggcaggtggatcacctgaggtcacgagttcaagaccagcttggccaacctggtgaaaccctgtctgtactaaaaatacaaaaattagttgggcatggtggcgggcacctgtaatcccagctactcaggaggctgaggcaggagaattacttgaacccgggaggcagaggttgcagtgagccgagattgtgccattgcactccagcctgagcaacagagcgagactccatctgaaaacaaaacaaaacaaaacaaaaaaaacctccatgcttcttgtatagcctgtagaactatgagccaaataaacttattttctttataaattgccctgccacaggtatttcttcataacaacgcaaatgaactaagacaacaagtctctgtgttctccttcatctatcatactacccgaggtttgtttacgtggtaaagacaaggttcggagagaaatggttgaaaccagcatagcttcttgagacacaatgacacttatgccacatgctattggccagagcaagtcacagaacatctggattcaagaggagggaaatggattccacaccttgatggaggagatgcaaagtcatatcacttgggacatggatacagggaggggtgcaatttgggatgtttttgcaattaacctaccacaggcttaaggaggcttttaggatttaccttctgctctaatgagtttcaaccaccatggcttagagaacatttcttaaaactcagtcatctttcatgtatccattgttctccaaagggactaagttttgttccatggtcagtcttttccatgtgttcttggaccttatacaaaacccaagcctggaattacagcacctggatttattcatcaagcattcgccagttcctggttctatgcatgtgttcacaaaactcagaacagggcattcctctgaatagagaagaaaaatagagtcagtcagaaaagaaattttttgtctaagaatacaatccaccgtactaccaccagacttggttccctttcaatgtcgagagtaacacattccttttatgtgttgcttaatttgcttgttttaagcagttccttgtttttggagtgtcttttttgataacattgagataccacatccactgatcatgtctaaaagctgacaatttctgaaggaaataaactgttcaaaattaactactctctcactatatatatagcattgtattttcagtacacatttttggtacacatattcgtggtacatattttccagctggcttgtgctaatgtactagtgattagaaccaagactaagaaaaaagtgcattgccattttcaatcaacgtgggtagagctgaatggttgattccaaatcaagttattttgcctaaagcaagacagataggagagagagagagagagagataatacagagatagataatcacaaactgccatttagagaaaatcattactactatcaattataagagtgattagcaagtttatggatagcatgatggctagcaatctttatacaaatgtggctgattttcactaagtcttttaattctcagaattgtttcatgacttttttggagaaaattgttgaggcatgaaaagaatttcatgactgagatagatattgtaccttaggaaatataaaatttaacaaatctgtagaaaaggaagacttaggctttgactttaaaagcccattccacttacaagatttcattttttgtttattcaatttggaaagcacattttcttatataatcaataagaagatttttatggcatgctcgagtgtagtctgattccaggtctcataattcctttgcactcaaaaaaggaactttgttacatcttgccactcatgctcactcttcagtgggcaaagtgactttgccatactgtcaccatccttgagccactgcccggtccttgaaaactaggattcttcatttccttttgcatcgtcagcgtgaggaaggggagggggaggtaagattctggacagctggactgaaaacaatggaaaatccctagtaacagcttgaatcactcactagcaggaggaaaatgtgactcgtttcttttcctctttagcttttgttgatttttttcataatgagctcagaaagagggaaagatcaatattcatgttgagttggtatccatcatagtgatattcagtgattataactctccaattctcactaggacaaatataaccacgcaaactggctaactgcacttgctggcatggttcctttggaaactcctggatttctctgaattacaaacagaaggagagttatagattttgtctctttaattttctgtctcttgaaatctcagatcacaaaaattgagtctttcttaactggtgatttcttattcgtcaatgactccttaaaagatatgcagaaagtaatggccctctaacccttcacctttgtaagctctttaatcctgaggggatggacttcctgatttctgttctctcagattctaaggaggaaaagactagctgttgtctctcaagtctacctattgctgtcctacagagcaaggacccctcttgttctccagctcctcaggaataggattcttggttccctaactctaaaataggagctcacaaggttattgtcaaggacaaatgagggcagtgttaacgtattaaaaaaaaaaaactagtcagagattgcttgattttcaaacttgatagtatgctttcgaagttacataatcaaaattatagttgtatttaaaatgttaagttcagcttacaaaccttcttaacctatttgtaagtcaagcaaattttaaaaatccttcttaagggaagcttgattaatgatttcttctcattttcaaatgtagttaaacatttttaaacacttaaagcttgatttgtaaatttaatacatttaattttaagtactttagcttgtctaacttaacaaatgagatactcatgaatatttgaatagctcatcaattagatacttataaatatgaaatatagtttttaagttcttttaaagttctcaatgtacttgtaaacttgtaaggatttcaggtcaaaacgataagtttaaatcatttactcgatttaacattttaaattggaagcacaattctaattcactattattttaataggccaaaatatcttaaaattacaagtatataaaatatcagggccaggcacagtggctcatgcctgtaatctcagtgcttttggaggtgaagccaggagaatcactcaaagccaggagtttgagcccagcctgagcaacacaggaggaccctgtctctacaaaaaatacagaaattagccagaggtggtggcatgcacctgtagtcctagctatttgggaggctaaggcagaaggataccttgagcccaggagtttggggctgcagtgagctgtgatcacaccactgctctccagcttgggtgatacatcaaaactctgtgtctataaagataataaaataaaaatatgactaatgcaaaattatttgatactatgggtttcatttcatacagtcatatgaaatgaaataattatgtatacaattatatatatatacatatatatagagagagggtgtaaatatataatttattcttaatgctcaatcttatcagagctgaaagatggttacccatgaaggaatcaatgacaccatttcacatatgattgcagttaccattcccttgtagktgctgggctagctctctcagctttccgagatttttttgaggctcagaggacctcctctcctgaatgagaactgggttctaacgaatgaccctaactgtgccctgttacagtggctctgtcttatgcccacgtgaagtgatgtcacagaccatattcacgatatcgaagctacacattactaaaccttctgccgacccacagaagcccaaaactcccatcctcatagtcatatcaatggattagattttattatatttgctgcaaactctttttataatgttcttcctactcaccttattcttatgtctattctattgagatctaattaaattatgaatgtctcttaagactctatctggctttatagtgacaacatcaaaggatatttgtattagttagggttctgcagagacacaggatgtgtgtgtgtgtgtgtgtgcatgcatttgtgtgtgtgtacacaagtcccaagatgtacaggttatgttggcaagccaggagaaccaatggtgtagttcccgtatgaaagccagcaggctccatacccaggaagagctgacatttcagttccagtccaaagtcaggaaaaagccaatgtcccagtttgaatacaatcaggaaggagaagttctttcttattcaggggaaggtcgccattttgttctcttcgtgtcttcaactgactagatgagatccagttacatgaggtagggcaatctgttttagtcaatttatatttaaatgttaatctaatctaaagccaccctcacagaaacaccagaataatgcttgaccaaatgttgggtctcctcataacrtacaaagttagccatcacgatattttcctggcatacactgtgaaaccactgacctggaaccctctgacttctgtcagctatttaatagataagtctttctaatcttgagtgtttgtaaagcagttggatataaatttgaaaatttttaaatgaaacgataaatcatgtgtgacctcttgagcctattaatcctaaagtaaaaagtccttgtacaaatttttatccactttttttttttttttttttttttgagacagagtctcgctgtgttgcccatgctggagtgcagtggcaagatctcggctcactgcaacctccacctcctgggttcaagtgattcccctgcctcagccttcctctcaagtagctaggactacaggtgcacaccaccactcccggctaatttgttcgtatttttagtagaaatggggtttcaccatgttggccaggctggtcttgagctcctgacctcaagtgatctgctggcctctgcctcccatagtgctgagattattgctatccactcttgatactgtttggcatgtgacttaaaacaagcaacagttgaaaatataaactagaaaatgagcatatatgttcattgttgctaaaggcttggtaccagcaccagctacaggagtttatagcataccttctcagagaaaggcctcttcattctgggtttagaggtgttggtatcctctgttgcaagatgttattcaatcaattcaatcctgagttttcaacatcagcaacattacatgtgcatttacaggaagaagaccagagtaggaacactttcattttttcccccaaccatctacaaaaatgaagattacctgaaatgtttactttatactatgatcttaaaactatttattttaataatatctatataacccagatcaagaaaaccagtgaaaattagcctattcaatcctttcaaaaggcttttttattccaaaagattgaataaaattagttactccctttatcctgaatttcactacaaatattacatttgcaaatgtcccatctgactgtaataaatgccagtgactttaactctgtggttggtgatatgaagaaaaccatatgtgatagattctaaatatataaccacaaaagccaaactgacggtttggaacatctcagcaactattattgattactacagttgaagaggttgaatcagtttgcatggcaattctcctcctcttcttcctcccatacccactcctcctctttcttatttttctctcttgctytctctctctgttctccattcgttgtttctttctaattcgcagtagcagtagcagcaaccagaaaaatatttgagaactttaaactaaatggttaactaataaggcaataaatagaaggtgtgacactgaacgaggagtaaaagccaatgcattccactacattgagagacatttatgaagtatattgagttacacagacactaacattcagaaacaataaaatagagacagtgtaaaaggctaaaaatgggctgggctcggtggctcacgcctgtaatcccagcaccttgggaggccaaggcaggctgatcacgaggtcaggaatttgagaccagcctgaccaatatggtgaaaccccgtctctactaaaaatacaaaaattagccaggtgtggtggcacacgcctttaatcccagctactcaggaggctgaggcaggagaatcgcttgaaccygggaggcagagtttgcagtgagccaagatcatgccactgcactccagcctgggcaacagagtgagactacgtctaaaatataaaataaaataaaataaaataaagactaaaaatggcccccaaaagatatcaggttaaatccctggaacctgtgattgttccgttatatgataaaatatatgatttagttaaggatccccagaggaggagcttaatctaaattatgaatgtagtaaatgcaatcacatgggttcttctaagagagacagggggtgttttgagatagacacacagggaaggcaatgcaaaaatggagcagaaggggttatagctaaaaggaatgccaagggccaccagagctgtgagaggcaaggaacagatttttccctggagcctccggaggaagcaggccatgctgacacattgattttgtccttctggcccccagatctaagaatatatttctgttgtgttaagccagcaggtttgtagccatttagcagccacagaatactaatatggacaatgatttctgagaaaataaaaagattattttgagaaaataacaacattccttgtttgatttttaggaaaagccattttattttaatttttttctatttttttatttttattttttacattgaggttctctttattttttactatttcttttttcttttcgtcttcttttttttttttttttttttgagatggagtttcactctgtcgcccaggctggagagcaatggtgctatctcagctcactgcaacatcygcttcccgggttcaagcaatttcccacctcagcctcccaagcagctgggattacaggcaactgctatcatgcccagctaatttttgtatttttgtagaaatggagtttcaccatgttggccaggctggtcttgaactccttacctcaggttatcagcccacctgggcctcccaaactgcttggattacaggcatgagctacagtgcacagcctatttctgactatttcttgacggccatccatgctgggggaacaccctcatgtgcctgtcaagcccaaatcccactctaaaaattcagattcccttttctgactccgtaggatgcctgtccacggaggtctcataaatccccaagcccacattttccccaagtcctccccctgctggttacctttcctttcccactcacatggagcaggtgtccgaaacaatgggttttgggcagaaaacgcattttagtcaactgttgtataaatattctaaactagtaattaagattttaagcatgtgctctggctggtcatggtggtcagattgcaaacagttggcaatcttatttcagcagtagactagaatctggtcataatttatccaagggaaaaaagacttgtcattaaattctctccaacggtcctaaaattttaatttatccacgcctaccttgtccattactgttttaaaacagctttttaaacgtctagattccagccctgtgtagaatcaaatatattagaacttagtcttgttacttggtctgaattggaaacatttccagtgcctaccagttgcacacatcattatccactcataattagttgtttaatctgaaaagagcaagttctgctccatcacctaacatctgttcacttttactcttagctctgttcaaccaaatcccattattgtcaggagaggctctggcagacttgtatcatttacgaatggtttctatttctttgtagatttctaattctttgttctcgtagctgctacattctctgataataaataacattatgcagttatttttcggaacttgtgcttgttttcaaaataacaagactaagaactaaagatttatttgtctgaagtcacacagtgcctcaaaacatatctcaaacactaaaaatattaacatccacaaactaacacctacttataaaaactctagcaattctgagagaaatggattatttacaatcctctctctgctgatgttactgttaaatgtcatattaactcccagttatactgaaaccattttaaatgttatagtactttgaccttggttgtgaaaataaagtgtctagtgtaattatttagggatagtatagttcctaattaagacaaaattttcagcaaagatgattaaaatttgataagcttttaaatttttgtgtaatttctccaaataatgaaatgatttctttttctaaaaaaatctataaatttccagactgaaatatgcatgtcagaataaaggaaaattttattatggatctgaagtttgctccattttataacacatctagaaaatttggggtactggcagagtgaacccacagaagagattctgatgaaactgaaagtggattggtaggaaaattgctttacaataatctctactacttgcttttcatgtaggggtttgggaattagtctcttatttctacaactttctatttaactgaaaagacctaacatcttataataggattacactttctggtagaattttcatgatacaattcatttaaactatgttctttgcatgttctgatgaagacatttcctatgatggcattttggtctttctatctccagggaagtcaagtgattggaaagaattttaaagagacttgggctgagtgcagtggctcacgcctgtaatcccagcactttgggaggcccaggcaggtggatcacgggtcaggagttagagaccagcctggccaacatggtagaacctcgtctttactaaagatacaaaaaattagccaggcagggtggcaggagaatactcaggaggccgaggcaggrgaattgcttgaacccgggaggcggaggttgcagtgagccaagatcgcgccattgcactccagcctgggtgacagggcaagactaggtctcaaggaaaaaaaaaaaaaaaagagagagagagagacttgatggttttctcttgaaaaaataatctcttagccattttccactgccacgagtacatgtacattgaaattagtgatactgaatttatcattggcaagatatctaaataagatttactgtagattaccagcgcattaaggagctcctggacaaaacatgtgcacattttctggctgagaagtgcagtcattgaagatttgtagaccagaacataacatattgaaccccatatctatctatatgccagtgtgtgtacttacatattaatttctcctatgaaagaggaattaataggaaaagaaaagcaaggaagtaatgttcaaaacttccttaatggccaggtgcggtggctcacgcctgtaaccccagccctttgggggrctgagaggggtggatcacctgaggtcaggagttcaagaccagctgaggtcaggagttccagaccatcctggccaaactagtgaaacctcgtctctactgaaaatacaaaaattagctaggcatggtgtcaggtgcctgtaatcccaactacttgggaggctggcacaggagaatcgcttaaacctggaaagtggaggttgcaatgagccaagatcctgtgccatggcactccagcctgggcgacaagagtgaaactttgtcccaaaaaaaaaaaaaaaaagcttccttaaaaacaaaaaaagcttatgttgccattatttgggctattgatttttttctagtgcaaaacatatacatatttgatatataaccttggaaaatacacaaaagacaataacaaaacactcaaagtcctgctatctaaaaataaacactttgcttctagagttacttttattcatatttttaaaacatatttataggccgggtgtggtggttcatgcctgtaatcccaacactttgggaggccaaggcgggtggatcacaaggtcaagagatcgaaaccatcctggccaacatgatgaaacccccactctactaaaaatacaaaaattagctgggcgtggtggcccgcacctgtagtcccaactactccggaagctgaggcaggagaatcgcttgaaaccaggaggcggaggttgcagtgagccaagatcgcgccactgcactccagcctggtgacagaatgagacgctgtctcaaagaaaaaaaaattatatttataattatagtgagtattccatttctgtgtcctgcctttttgtatttatctaaaatttaatttaaaaatttctagatttctctgtaaaatcctgggaaaatcaaggcaagttcatagtgatctatgagtaatctattgaaatagcttggcattacataaaagcaatcccttcaggtctgaataaaaccataaatagaattttccttttggcatttacttcattttagactcatttaaatagtaggtttatcaatgcagtttattctgagcagagggatgatgtaatgtataatcagttactcaagtcaaaatgccaggaaagtatatgaataggtagcaacaaggtattgggttgaaaagaaaatgcttggctggctcttagatggcttgccctttagttgctactttccttggaccctttccagggtctccaagcatgaaggacccatctctcaggaagaagtccttgcccagggctgtttatcttagttgagtacagccaagtacaaaccagagcgaagttgggtcttgatctcctattgggtgccactgtctctgctttcttttatggctaacaagcctatactaccacaagccacatttcatttgatagcatgggtagtggaagagagcatccaaagccagtcaatcctaaatcatgtctgcaaaaatatctgtaaggataaggcctggtggacctcaagaactgtctccctctagtaataatcatataacattattattttkcagtgaaaaattatccagtacacaagcagtctatgcaatgtaatgagaagaatgctttgcaactgtactactagaagcgaactaattcatgatttatttttaagtgattagaacccttagtttatctgtgagaacatcacttaaataaaatgttttaaaatatgcaatgcatatgcaatagcattaaagtattaaatagcatcttaaagagcaaaagaaactattaagaataattaagtggatttattggctaattggtgtttccacatgtagttatttctgcaattattattcatttgctgatttacatagagctattctctaaaattactctggcattaaatgaagttagaagacatctccagtttggaaaatctattaagcaaakccttttcaacttaaagttgaggtgatactgaatcaaggcctggcagaactgactayagactcagagggagtatgtttattgcttttaattcttcctatttctgtttgaactaacatggcaaaggctttcatmttccaaactacacttatccagtctataaaacaaagatgatattgtttcaactataaagcacagattaactttgggaggctgaggcaggcagatcaccagaggtcgggagttcgagactagcttgaccaacatggaggagccccgtctttactaaaaatacaaaataaccgtgtgtggcggtgaatgcctgtaatcctagctactcgaaaggctgaggcaggagaatcgcttgaacccaggaggcggaggttgcagtgagccgagactgcaccattgcactccatcctgggcaacaagagcgaaactcagtctcaaaaaaaaaaaaaaaagaaaagaaaagaaaaagatcgggtgcgggggctcacgcctgtaatcccagcactttgggaggccaaggcgggcggatcatgaggtcaagagatcaagaacatcctgaccaacattgtgaaaccccgtctctactaaaaacacaaaaattagctggggatggtggcatgtacctgtagtcccagctactcaggaggctgaggcaggagaattgcttgaaccagggagtcagaggttgcagtgagccaagatggtgccaatgcactccagcctggggacaaagttagactctatctcaaaaaaaaaaaaaaaaaaaaaaaaagaaagaaataaaaagcaaatactaccaaattcttacctaccagagttacgactgctataacccttaacatttaaacaagggaaatcatcatttgggaattgtatttcctcttcatacaaactagtcttccatggtaatagattggctggatgtttttccagtatgttttctagataaatagtccttggagccattgtttccctaagaattaccaaaaaaataaaaacagaaagcaaaaacatgtttgctttctgctggaacatacatctcaggcagtgccgaggactaaagataaatttgatacctatggaggaatacattctaaaaataagattttatatctgtttgcatgttaacaaaacttatttgtaaagacacacattctagaaagtaacctcaaaagtactcttataaagcacctcattttgaaagtcaagtagagcaattcctgggcagatgataatgatactgcagagacatgtgaagaaggaaaaaaartaataatttcgctccctgtgttagtctgttctcatgctgctaatgaagacatacccaagactgggcaatttataaagcaaaagagatttaatggactcacagttccacatggctggggaggcctcacaattatggtagaaagcaaaggaggcgcaaaggcacatcttacatagaggcagtcaagagggcatgtgcagaggaactgccctttatcaaaccaccagatctcgtgatacttattcactatcacgagaacaggatgggaaaaacccactgccatgattgaattcccttccactgggtccctcctgtgacacgtgtggattatgggagctggaattasagatgagatttgggtggggaaacagccaaaccatatcactccctaagactattacatttcagcagttagatgaagagagaaggacagggttcagattgaatcattttggatggaggagaacatataaataattgaacaataggagcaccacctagtttagagacaacctaccacaggcaaatacctcacatgacttcattgttctcccccacaccttctctaccatcagatttcacccagaaccctcatgtgccacagaacttcaagtaaataccagccctggaatactagtcagaaagctgaaaaaaacgtgcaatatgagtttgaacactctgagatcgttaacacttttttcaataaggttagataactaagatgataaataaaaatattttaaaacattaataaagaggaaatgattctcatagaattagtatagccaaattttatcttcttaattgttgtatttcatcaagagacatagataggattaattttggttttctactataactgcttccatcagggaaaatagattaatttctaaaataccaccagaatcttagagttgtttatccaagaatctctaaagacactttacattgcagagtaagtcaataacatgggcaaatataaagctagggaacatgtgaaaaataaaattatgagttacaaacattaaacattatttcagtagaaacagattggtggctgcagttgattattaaagaatgccattaagttgtcaggaataactgttgtagttttctgaaaatagtcattttgttgtagctttagattggattagctagagctatacacacgagagatgcacatcaggccttagacacaaattccttcaggaaaatgattcactggctatttagggggttgacagccagtatatgttgttttcgagtcacagagaaaattgtatggttgtatattctgctttaatttacatcaatggaagatgagctacaaagcagctattgatacaaaaggcaaacccattgtagaaaatgaacattttctgtaagctacatctacattcttcctgatcagaaaataatacagaaagtgacatacttgttcctttttcacatttgaagaaaatgttacaaatgcctccatgatgcaattctgtatttagacaatctaagcattgagtcttgggatacttattctgtaactattttctaagaataacctgaatagaaaacatggaatttggtagtaaaagatataaataatgaaaataggggtagggtcctgtgcctcagtgaagtttaaaatttaattgaacttctaaataaatgtttaaaaatagagcagtttcaaaaatacaaaagctagaatattcatagacccctgaagatacttctacagtatcccacagttccacaatctctgattcaggaaattacattaaaagttatatgttggcattttggaatttcatttggtatacatacctgcagacagaggcaataaaatcacatcaatggtcggttacaaatgaagtcatccagttgacccagggtatgctttggctaaattttgttttagatttkccctaaaatataattgcaatattgaatatctctaatagatctcaagggccctctattagtccattttcrtgctgctgataaagacatacccaagactggacaatttacaaaagaaagaggtttattggagttacagttccacayggctggggaggcctcacaatcatggtgaaagtcaaggaggagcaaatcacatcttaggtggatggcagcaggcaaaaagagagcttgtgcagagaaacctccattttgaaaaccatcagatctcgtgagactcattcgctatcatgagaacagtgcaggaaagaccggcctgcataattccatcagctcccacgggttcctcccacaacacgtaagaactgtggagttacacttcaacatgagatttgggtggggacacagccaaaccatatcaggcccactttgcaaaatatcaaaacagaggggaaaagtataagtaactgaagagaagggtgcggtgtgctgaatacaaagatgctgactggggggagtgaatgtacctgcatcccaatttgcctgggaggtctggttttacccattgtctgacattctgtctaatttagcatttgtcctgaatatttcatttagtgatgtattattgttattagttgcattaaaacaagccaagatggattaggtagacctccacgttgtacttccagtttcgtcatgttatggtcttgggggtgcaggaattcccaggtttccttgaggtgaaatctgaaagctgagaaatatagcacagctcacaaggaagaagtggataaaacagtgtcctcagagcagccagggaatcctaacccctgacgatcttcagtgaggcatttggtactccaacctgttgtgccttagccctgagccccagtctgtgaggtgcatatggtcctagctaataggtcagtgggaaaagggagaaataataaacgaggctgtgtgtaaacttacgtgtaggaaacaggttaagctgttctgccctgttgcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggcatgcagagagtagtctgaatgctattgccacagtggttttatwtttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggccgagcacgggggctcacgcctgtaatcctagcactttcggaggccgaggagggcggatcacctgaggtcaggagttcgagaccagcctggccaacgtggtaaagccctgtctytgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtytccaaaaaaaaaaaaaaaaaaaaaaagagaaaagaaagaaaagaaaagatgaacatgtaacttacacaaaacacttgttgccatttaccatggggatataatgaactaacattcagaagtcacacatatgctgaagaagcatcaggatctacttcaaaagttaaaaacattaaaaaaaaacacagaaaaaaagagtgcatcttaaaatgacttaacacacacaactgcagaaggtggagctacagaacatgcttggaagcacgactttttatttagatcagatgattgttctttgacattaagttagctcattggcaatttcatgatttcttgtgcatatcccaaaatgaaatgacacctgttaaagtgccagcaccgttagcaaaagaacatttaaaacagaaagtggtgccagttttatttcaatgtcatcagatgttccaaacagaaaatcactccagttaattcttgtaatggtttcgttttctcatccaattccgaggaagaaactaaagctttttgaaattaattctgttgaatgtattattcatactattttaaattcagttaatatttagcctacatttctagcatttgtctaatattaacacagtttttggtggagtactgcatcatgaagaaacctaacactctgaaatttaaagatacgaaatttacttggaaatagtttttatgtacatataattcatacttacatccaaataaatgttgatagtctctcaattaaaataaaagctgtaagtttcaaatttttgaaataggtacatatacaattggatcatctgaactgtgaaattttgttaggaaggtaatgttgactacaaaaaaaactcagaatatcaggattcactttttctctctgctgcctttcttcggttggattttagaaacgttcatgagtgtttaatcttctgtgcttttaaaattcttctgagtgtcttaaaatagtactgaagttttcatgacagtcttttcatttttggctgaatattgttttaaaatcatctagaaatctttcatcaaagtaccagtgaatggaacagcaaaagctaaagatttcaaagcttttatcaaaatgcgattttcgcaaacaaattatgaaaataggaaggcatggatatgtatctgcaaaggcaagggagaaactaaagaattgtagaataaagctcaaatattataaaatatgtaatttgaaaactccaattgtgttttgaaatattcagtttgtgggaataatagtttgatgaagtttcaatttttaattaaataaatttatatagagcagatataatgaaattgaagacttagtaaaactttcaaaaaaatcctaaagacagtttatttgatgatttttgacttttaaatatttgttaatgaaaagtattcttagtaaaaaaaatataaaatatttgggctgaaatatttaatataaataattgaattgaaaatattttctgtttagcacaagctctgagcttgttaagtaccttgtgcctgtgggagaagctagtctttaaaagtttaaatattggccaggtgtggttgtctcacacctgtaatcccaggcgtgattaatttgggaggctgaagcaggcagatcacttaaggacaggagttcaagaccagcctggccaacaggagaaaccccgtctctactaaaaatacaaaaattagctggtcatggtagcccacacctgtaatcctagctactagagaggctgagaatctcttgaacccaggaggcggaggttacagtgagccaagaacatgccactrcactccagcctgggcgacagagagagactctgtctccaataaatacataaaaataaaaataaaaatttaaatattattgattaaagataagaatgaattagttttgtcactaatttcatacatattaaccatatcatgccactttgaagaagattgtaggtaatttatgaaaaatgttcaaataagactgtatttttttaaatacttttcttagaaaaatactagtgatatactattaaagacagataaaactttaaaaaattgattaaagtacttgcattctacttattttaatgttcagattgattttatgaagaatttttgcgttagtgaatgaagctttgtgttattttatattttagaaataattctagcatagcatagaatattttataggtatacgaatataataaaaccagaatgttgttcaccagacgaattcttcaaaaaaaaatacaatcttcacttttagtctactttcttactctcaaaagtatcctaattagtctagtgctgaagagtttcaaactcatttaaagagaagtagacaaataagtgacaggaaggattgccgtgtgtatcttccagtctggggtgatgtttaaattcctcagagtccacttagctttgtctcttcaccagccttggtttgccccagtgctgttcatcattttaacaaaaatagatctcacaggatgttcacccagtcacctttttgtagggacaagctttatagtcctagcacttgctgattctttaaatactgtgctttggtccaggggatgttaccttaagcccattttttgtagttagtaaataagacttcttcccaaagtcacgtgcatgttcaagttcttgcattgccagtgtgtaatggataaagacaaatgtatagtaaaaaaatcatgaggcagtctttggktctcatcccagccctgttggctgtgtgatatttggcaaattattttacttctctgagcctcttttctttccattgtaaaatacagagaatgatagttaagagtatttttgtggaaatgaaccaacacaatgcagctcaagtatcttagcagagtgcctgtgttcaataaatattaataaaatgacccttaactcccctcagcaagtttaaaaacaggaagtttccatttcaccatttactttccaattctttgttaaagatggccataataagtaatgagagtgtgcatttgtaaatgtctgtcaccaatgkgaatttacttgagatgactcaaaccacattctatactggaaaaggtgcatttaacgggcaaaagaaaagcccaggccagtttctttctgtatcaaccctgggtaaatctccttaagaaaaaattaacaatcatgatttattcatagggaaagaatttaactacttgttagcattcgaatgggtcctaaggaaactcccaagttaattaaatcagaactttcttcttgagtttgatccattatagtgagttaccagctgggtatcaactgctttcccagaaaggccccattgaaattaatggactcagggctttgttgagtctggacactagagaattggacaaatgacactgtggtttattaaagaattatgactgcaaatacattatatgatgctttctccctctctctccatttaattatgaatctgcctctcaaaagccttgactctgtattttaaagttgacataaatggtaggacgaggttactttttccagtaatggagaaaggaggagaaaggttgctccgaattttgtgatcttgttcattttccgatgaagtttttttgctggtccaaatattaattaatcgattgattgaaaatgctacaaaagaggagccattcatcaaagaaccaaatccagtgattcgtgatctggggttttatcacttatatttctagagcatccttttgcttttacaacttaaatttaattgaaattttaatccctagcaggtttttaataaygggcagcttttgagacattaaaaaacattgctctcacttcccagataaggaggttgtccagatatccttatgctttagggagcatttactaagtgatggtacttcccagcgcacatttttggttttgttaaagtatcttaaaccgcccatgtgtagtcaacttccccttatggaatccattgataaatcatggcaaaaggaaaccactctatggaaataacgtctaaaggagaccctctttatcccggagaggaaaaccagagagcagtcacaatctggctaacataaaaagaaccactccttgatgcaaatcaaaagactagatgtagctaattagacatgggaaaagggtggttctcctgaaaatctggggcctcaggcattttctggaatgtgtacagtcagaacgtgcaagttagtcagcaaagagaaaacaagcagccacacctctcccaaataccgaatagtcatccttcttttgtggttcagaggtgtttgtttgtcttakaatgctgcaacttaaaaccaattgattttaaataaaaatggtaacattataaagtgtgaaagtgtggggttaggaatcatttcccaccctgtgaaaatggctctatggtcacccaggggtgtgtgtgtgtgtgtgtgtgtgtgtgtgtgtgtttgtgtgtttaacctgtgagataagaatggtcaaccagttgactcctcaagaacagtctagattgctacaggcatgaagttgctttgagagcaggttgaatgcccacacatgtaggtttggtagaggtggtggtgaaagcggtgagcatggctgcagggtactcatgccactcactcctttttgttacctctcacaacctctctctgtctccatctgacatgcctccctagactgtctctaataccattagaaacttcagcgcaaattgtgcaacctctccgacactgaccacaaaccctttccagcctcagaaatgttcatagatagatgagggttatcagggttgctcagccagtgaactccgaccacgctgggtgaggctacatttgtaatctgttctggaaaacgggaaccatgctccattttcaacctgcactcacccactcctatttctttctagggtgtctctgtttttttgcttttaaccttgggtttgactttttccagtggacatttctaactaggaaacttgatggtttccacttagattcccttattctccaacttaataaacatcaatacatttagaatccttcgctttccaagactctaactgatttgtggccacagtgatctttaaaattcattagactttcgtcattccattttctttattaaggcatccatatgagctgccatgtgtttgctctctttcatatatctgaatttactgattgttgtctccaaaacatgttctatcttagacactatctcatcctcttctctgccagatattgattattcatacattctctgatcccaaccaccagctttactcattgttatgtctttgtagctttttcttcccttaaatacaaggacaacctattatttccacaattcagcactttttactgggtcttttacctstctaaacccaacaagagcatcaaagcatgatgttgggcttggtgcctctcttccaccattctttctctttttaactccacatgtgtgctggactcttgcttatgatcttccctgtgtagctaccaccacaaaaatgtgtccccggcctttacaaatgaagtgttcagatgcaagccattctcttatagacatggcagtaaagaccaattaaaaaagggggaaaattggtgctacaatgtcactttgcgggagaatgatgtctgtaaagtgggagcctatgtcttgcaatatgctgatgccctggttgaatagaccaaactattcattccttcctctatggcctggggagatctctctccatcacacctcagtgaagacagctttgatgcatttgactgtggtgccttgggcctcccagttttcaatttttatttgtttttttctggtggctgccttcttgactgctgatgtgtagcttatgaaggagtgaaggatgtgccatcccaaaatatggcagattggtatattgagtatttcaagttgaaaacattggagacagtgtagtttcagaaaaggaagtctgacctgtctcttcctgcatgtagcacaccataaagattcctctgggaggggtacccttgccttaccagggcgagaaaatagcccttaattaccagagacttggaactggaggctacactggacctgatatatacacttaacaaagtaacgcttatgtgcctgtggttttacacccccccaccccaaatatctcctagtgactcccctagaaaatgtactgccctggccagattttctttttgctgtcatttcttctcaaatgtattatcattcattgwctaaaaaatataaaagccccttcttcagacttcactgtcttgtgaagatcttcatgtacacgtgaaattaatcaaatgtgtatacttttctcttgttaatctgcctggtgtcgatttggtttctaggtcctgctgaggagcccactaagagctaaaaggaggattgggggtgatcactggctctcctacagttatgccctattgttttttttctttaaataccttttccaacaactcgaagctcagcagtatggtggacttcctcccttgtgcatagatattgttgcatcatttctgtcttccagagaactacacttgctaagttcagaatactttatcagcttactttgtgtccttgttcccatggtggtgacaccgatcttgaagcttaaaaaatcccccaaattccgcctcccacctctgtgacactcttttgcaaaaatatgcaatttttctacacacatttctgacaaaaaggaaaaaaatgttaagtccaccctagktctgtccagacaagcacagagagaggcgtgttagatttccagacaaatattttcgcctagattttgctcaatgaacttgattcactgcagggctttttttcccacaagcgcgtggcagaggtgggctgccacaggagtggccagtgcccgctctctgcagggcactgctatgaatcaccattttcatgaatggaaagaataggaggaggggaaaaaggacaagcagcttgttgctaatgccctcaaacaaggcaaacattttgtgaataatttttagataatatatgacggtttggatctttggttttgttgttttgaatggaatgcatagaaaaaagaacttgtttcaacaaaagtttgatctgatatcctattcatgggctgattctttctcaaatatttggcagctcatccagggcacagaaaaggcacagtgttgaatcatgttgctttcaagctctgtatcagtggaaggcactggaagggattatcgatcccacaaaatacacaaggaaagtatgtgcccacttcatttctgaggaaatttagggttcagatggaccttgccatagactcagtgtctttagtagaggccaaataaataaataagccaacatagatgccaggcaacttaccatacagcatgctgaatttcttccctcatgtctggtgactggttttatagaacccattcagtgagaatgcaggagaagtctaagaattagaaggaacaaagaaaagagaatgagcacgggaataaaagtaaataataatcatgtctattcttgattctggggactggctaacttctgtcactttaaaccacttcacctcatttgaaagtccaggcttctcagcttgatgtccaaggttctccatgacacatatcytcttgagcacttcacttcatgccccgaccaagcttggacttcttccccctcacatgcttgctgtttcatgtttcatgttttagctcatgctgttccctctacctggaacatcttggttcactcaactaattctacccatcagaatttagcacaggtgtcctcctctcttcatggtcttcctaaatacctcttgggttcattattcctcttccatgttcatagatcaccctgggtattactctgtgctagcactttccttctttctgctatgtagtaccagtcaggcactcaggggaaacgactatgccattcactcattcagtcattcattcattcattcaacaaagacgtattggattactattatgttccaggcactgttttagggactgaagataaggtggtgaacaagacagataagattcctgttgtacaggagtatgcattctggcagggggatagattaaaagggaaatcaataagctaacacgttaagtgctaccgataagatgaaaatatgtcaatgggaagaagagtgcctgctgatttagactgggtggtcaggcaaagctttgccaaagagatggctgaagctgagagttcaaatgcaagaaggagtctatgaggatctgggcacggagtgtctgagttggaggaaatgcaagcacaaggccctagaggaagaatgagaactgtgagctcaaaaacctagaataagccatgtgactagtgaacagcatgtcccagcaaaagtcacacttagaaaatatagggcctgagggtcacaggaaaagttgtttattctttacctgatgggaaaccttgggacaattctaagcagggagttggaagacgtgatttatattttgcagaaatcaccaaggctctgcatgctgaatagattttttctttgcatccccagaacctagcacaatgcctgcctctgtttcagtagggcccagagccgtgctgcttttccacacaggaaaattgccttttccaaggtgcatggctgcccagtagagaggaaagctcaaagtcatatcaattcaacacgcagtactaagtctctcctcttgctccattttctactggcctgtgaccaactacttcctaaagttgaaattgcttccgatttcttttttctctatttcatggataatccatgcagtgtttgctcaacctgtttacactgagatgtgttgaggaactgtcccacggcaagaccacaaggtggggcagtaatgagtaattggaagaaaactgcggtaccttctaaagctcaaatgtggctttctagaacmcgatgaagtggagccctacattcattatttgaccttggttgttttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagccaccatgcccagctaatttttttttttttttttttttttttttttaggagagacgggatttcaccatgttggccaggatggtctgaaactccggacctcaagtgatccacctgcctcggcctcccaaagtgctgggattacaggcatgagccaccatgcctagccctgtgactttttctcaagggcttcaaacagtccctctgcaagttaacctaggcatactcacagagcaagaaggcattcatgataccacaagggaggtgaggtttgtgccatttgctccatgtcactgaggcaggacagccctgtgtggctccattcccacgagagaccgtcttgctccgttaggactgcctcccacctgctaagggtgcttttcttccatggtacagtgatccttaatcatttgtttcaaaaatgtaccaacctcccgggaatgaaactaaccaaacttccctccctccctctctccttcccttccttccttccttccttccttccatccttcctgtttgccttccttccttccttttggattatgttgtttcattaaaatatatttagctgggcatagtggctcacacctgtaatcccagcactctgggaggcagaggtgggcagttcacttaaggtcaggagtttaagaccagcctggccaccatggtgaaaccctgtctctactaaaaatacaaaattagcygcgtgtggtggtggacgcctgtaatcccagctactcgggaggctgaggcaggagaattgcttgaacccaaaaaaagcagaggtttcagtgagctgagatcgtaccactgcactccagcctgggcaacagagtgagattccgtcatatatatattcacatgatttaggaaattctgtatttcagcatcacagtataaagacttaagttctaagagttgatattgctgtagatgttgggaatgraatcttaggagtaacctttaccggaggcaacttctactgcccttgctacctttggtgtgacctgaaaccccctttcttcattagtaccaagtgacttgtttgccactactcagctgtcccagaatagcttgactccacacatccatgcatttctaggaagaaattaggtgcattataaataacgagtcctctgaaaatgccgaagtgtcttaatcttttgaaaaaaattatctcaaatttacattcacaaggagccatgtcttttgccactaactgaaactcagtaacaacactgaagtatgagcttgggccttgtctgacaataaaaaggaaatgctaggtcccagggaccacttcaagatgtgcttgttcctttaaagcagggagttgtcacatccaatttttaacacatatgtatattttaacacatatgcatattttaacacacatatatatttctgattatactgtaaaactggtaaattatttttaaaamatcataaggcccccaaatcccagagaaagttgtttctattacaattttagtctatttgtctcttttaagtttctcttccctctgagcatatgtatctctaatgcatgtctgcttatgtaggcatatttatacatacaccctttcttttacaaaactgatatcaatttttgtattttaaataaaatacaaatgttttacattctttctaaacaagcagacactacttttggcacctcccaatgctggccaggtcatgttaactacccttaatcagctttttttcttgcaatatttgtaatatgcatcatctcagggcaagagacaaattagatcatttgaagattaataaatccttacctctgtttggttgcacttagccagcaaattcatcacatgcttagtctttgctttattctgggccatgtagactagctgttaagtggaaaaaaaaaaaaaattcttcttcggggcagagtggcaggatggctctttggaaagagtcttggagcaggagtcaaatggtctggctttacaccccagctatgcttacaaaagctgggtaacttgcagttcccttaccactaaagtggaaacatggatgtctaaagcttttttacagctagaaaagtctatgcttggttagcattgtgctgatgcaattctgttccagataaccgagggagggaatggcggtcctcgcgtgaagacgtaagtagacgtgctattaccctcctcggttggctccagcaataagcctaatgacctctacaaagctgttctgtaatacagaagtaaacacttactctgcacaatttctccttgcatgtgcttcccactggtagaacattattcatcttgttggtctttccaaagagattcattacttccttgctccttcttattcatccttcataatagaaatgctaaaagtctgaaagaygaggaagggagcacatttcctccctgcagtctgaggaatggctgtatctcttcatgagcaccaagaggaagcccccagatgggtccctgtccttacagccttgtttccatgtgcatttccaccccagcctcttccataatcgctccccatctctatgccccagcgatgccagttgttccatcaaacactgtcctctctgttctcagcctcggagcttctgctccctctgttaggggtgactgattctcaccaccaccaggctaattctgactgttctggtttcaccgcggatgtcacctcctccaagaagctcttctcgactttctgcctgcagaccctcatctaagctttcacaacaccctgtgttctgtgtttacacccacccaactttttcttttttaaattttattttaagttctgggatacatgtgcaggacgtgcaggtttgttacataggtaaacgtgtgccatggtgttttgctgcccctatcaacccttcacctagatattaagccccacacgcattagctgtttgtcatagtgctctccctctgcccacccccctgacaggtcctggtgtgtgttgttcccctccctgtgtccatgtgttctcattgttcagctcccacttatgagtgagaacatgctgagtttggttttctgttccttatgttagtttgctgaggatggtggcttccagcttcatccatgcaaagcactggatatcattcctttttatggctacatagtattctatggtatatatgtaccacattgtctatccagtctatcattaatgggcatttgggttggttccatgtctttgctattgtgaatagtgctgcaataaacatatgcacactcaccgaactttgcttcactgtctatcagaaaactgccagtttttcagttgcatttatctcctagaatataaaggctttgaatagatccaatggtcttgtttaccattgaatctgatacctaacatggaatctgacacctgctagacaccctcagaatgtctgtgaaatgatgtaactctacgtgatgtgtgtctactcatagctgtaaaatgagtgagccctcctgtaggtcacagtgtccagcagactggcagggacctgatatgaacatcacagaggaaaaaaacacatacgaaacaattaatgcttgccattgggccaaatgctttgtatgtgttatttcatttatatttttatttaatactaagcagacttcatgtaccctgtattttgctaggcagtggagtacatagaaaggaacagaaactgcgtatcttgtcttcccaactgaaaggagacgattaacctacttgaagatgttagaatacaaatacatgatatctgaggacagggtgaagaaaaacaaacaaataagaacatgaaaaactgtgtttgtcttgactattcaggatatgaaagtgccgcaacattcatgtatctagaaactccatgaaggaatctacacttagggcttaaagaatcctaagggaccgggcgcggtggctcacgcctgtaatcccaacacattgggaggccgaggtgggcagatcaggaagtccagagatcaagaccattctggccaacatggtgaaaccccatctctactaaaaatacaaaaattagctgggcttggtggcgcatgcctgtagtcccagctactcgggaggctgaggcaggagaatcgcttgaacctgggaggcggagggtgcagtgagccaagatcgtgccactgcactccagactggtgacagagggagactccatcaaaaaaaaaaaaaaaaaaaagaatcctaaggattcctggttcctgacaggtgcttgttccttgaagtatacttgtgccgggaagcaaatcttctctctctcgttttgaacttggaggagacagcagctcccttctccttttcatacaggttattgtttataagagcaatgtgatgaaagcttcctctgctaagactgcaactccagcgttaccttttctttacctcaccttgatcctcggtgtgaaacttcactcattactgatgcattgcaattaacagatctcctctttcaagacacattagggtatgttctgactatcagctccaaaaaaataaaataaaataaaataaaataaaacacattaggaaatttaaatgaattagtgtaatcagctgagatagtacttgaaagggaccgtgtaggcttgtggtggaataggtactttcagacagaagtctctagaatattcctgaggaagtattttctcctgcccttcaatgaatagagtggtaaggtttgtgaaaagcaggcctctggcctgagttagggaaattatatattgtttgtccaaagtagtaaactctgtctaaaatgaaactctagactagatattattttttgatgttagatgtatacgttctctccatgatttagcagactttccagggaatgatgagtctcccctctactgaatactataaacatgttatctcagtgggaaaaatagaaagagatccagagaagaagagggaacatcttgcttttgaagcatctctgcttacgagtccataggaaataaattacatttcccagggttctgatttggtttttaataacttactggccctgctaaacaagacactcaggagaaagtgcatgtgaatagatggagatctacatttttagaaaatatgtttctttcttttgggatcacaatcagaacataggcatcattgaaacaaagccgaggaagaagaattttctcatgctatgcagaagttttctgttaaagatatcagaggctttgcaccctgagagctgtaatcttctctccttgagttcttcattgagatttactgcagaggcctcagatgtgtttatttctattatccagttgctcctaatattacttgcaattgttttggcatgagggttagaaattgcaagaactcctagctcgaaatcacagaacgtacacaaagacaaaacagaaataaagcagaacaaatgcaaggataaaatagataaaaatatctccccaccctaattgtgctcttttaaaggaatgctattgaaatgacaaatgaaggagatttctacctgttgttatatagctgggcagagtgacatttttggctgtattctagtgttgagcagttgcaaagctttctttccccctgaagcagtagagggtgctatgtggatataattgaagagatgctaagtttctatatgacgccagggcttagggactgccctctcttttcaagccacttgcttttcccaaaataactaagaaaagggagaaaaaaaatgagtacagaggccatgctagaagacatagataaaatattaagtcttaagaaaggtaggaaataatcagattctaaagttctcacaaggtttggtattttgaagtatttggcagaaggcaagggtatggaaaactttaagaaattgtaagcttaggactttatcgtaagcttaagacagagatgttatctgtctgaaaacagagggaaaattttgaacagagtgattcttgtaataagagaagacttttgacaagttatgaattccttgaatttcattattttttcttgctgtttaagtagtatatattgtatatttgatgacagtcagattttactgatagagatttgaaatatattttgatagggctacctcatgctttttgtagaatcaaacattttagagctgttcagccccttggagccattaagtacaatcttaatgtttttgcataaggagacattggcaccaagaagttaagtgacttaacctgtaacaggctggtccaaacatccgagcctcaactagaaccagtgtccttacccctggtccaaagctctctgtcttttgctaccctgctttgagttacagcattttatatgctgacaatacataatcctaatacatttatatattgttttcacttacaaagcagtttatgtacatttttccacacttatgtaccaaaacgtcctttgaaaatatgttatttgttgatttactcaaagaagacttgcccagttttatgacaggctgagaagttaagtctcctgttgcaattccgtttgcaattcagtatccattacacctggtcaatcaagtttcttattaatcccacgttttccctgcctgtaaactcccttcttagtgaccgattttgctattttgtgtgagcacttgagtaaaattcaactgactcagagtagggaatcctggctggattaatgggattgtgtaacaccttcatcacttgaggcccagataggagtgactgtgcgatgtaaaaaaggcttgccaacaccactgatgtttgacgtgaaggtgaaaagttcagtggcccagagaagtgctttaaagggttcttcttaaatctaacacctgaaggaacaccttcagattatccagcagttgtgatcccctatgcagtgtctatttgtmtagacttcttccccaacacacattccctagtacatttaaatggaaagaaaggtctgggaggttatttgcaggggtgttgatggaaacaggacccatcacagctagggtcatgttatcagagtgcagattttgaattcctttctgcctttcctgcatgactttaagtaagaaaatggtcaccttaaatttgcccaataagactcagcttggaaatcattcttgggatgcagaaggatctggtccagaaagcttcagagaagccttgagaactgcctattcaagaggrgaagaaggctgagagagggaacctgcaaagatctagcaggaaaagagtcttctatgtgcaaacaacactagaccctttcccagaattggggcactaacaaaagataatgcctctgaaatattgggaaaattgttggagaatatgatctcgttccctatgctgtcactccaggtaacacccatgatgctcaaaggatttttttaaattaaaaggagtaccactttatttaacaggtagaaaattatggaaattattataccaagaaaggacataggctaataacataaattaggcttaaggagagtttcataaattatgtatctccaatggattaatgaaggaaattaggaataatttttatattatctctacttttttacttatatatttggacttgaggttttctgcatataatatgcrcactaatataaatattaatataatgctaatacaaaggaatactctctcagagattgtgcattaatgtatgtttcagtgacaaaatatagtgcgtgaccttagccccaggaggaagaataggatatgtgaaagaacctaagattttgracccaggataacctggttttaagcccaggtctgctacttaagagctgtacgactgtgagcaagttattttaaattgctggatcttgttttcctcatttacaaaatagaaacactgatatctgcatcatacatcatactattgttatgatttttaaattaaaaatatatgccaatgaacctagcaattggtgaccatattgtaggtacttcatggatatctgcctcttccttccatgtgcaaaaggaattctggcatcatcttttataattactaggaattttttactgccttcagaaaatatttctagacttatcctgctaatttttgtttagaagttagcctctgtttcagtccattctctcattgctataaagaactacctgagactgggtaatttatagagaaaagaggtttaattggctcgtggttctacaagttgtactagaagcatggctggaaaggcctcaggaagcttacaatcatggcagaaggtgaagaggaagaagagaagtctcaaatgactgaagcaagaggaagagagcaataggggaggtgctacacacttttaaacaaccagatctcaggagaactcactcactatcacaagaaaagcaaggggaaatctgcccccatggttcaatcacctcccacagggcccctcctccaacactggggattacaattcgacctgagatttgggtggggacacaaatccaaaccatacagtccctgaatatatatgtgcagaaatagactgctcacctagacttcaaaagacatgtcatcattacgcacctctgagacattgtatggtcttggttttaaatttcttgagtaatctggttaattctgatactagcgatcaacagctttggtgtaaaggtaggtcagattggtgatatattgctacagcaatttgaggaaatcaatttcctccctaaaagttttgacaatcttgtttatttatatattttatggtggtgaggggagaaattattcttgagatcttgcttctttgaaatatggttcttctcaggaatatcctatgttattagatgatctaaaacactgtggcacttcttaaataaccaatacttaagataccatgaaaattacaacccccgtgagatatagtatcaattaaactatgccatatacctcgattggttgagttccatccactagtcaatttcaaaattacctcgtaaatcactaagacaataggaaagaaagccttactataacttgccttactataacttgtcttactcccaaatttagcaatatctttttagcttattgatggtatttcaggaaaatcaaatgtagttccacattataaggatggagacatgtgttacctctttatgttcctgtatggcaaattagttgatactctttggtcttgtcgacatctctttaaccttgtaagattataaaggttagaatcatgtttaccacctgtaaaaaaaaaaaaaatctgacagcagtgggttttttttttttcttcttcttctttttctccaccacatcccctgataatgatttccatgggctggaaatactgggaggagagaaatatttagttgaattcattttaaatgaaaccaatagcttcactagtgatctcataacctcaaagcactttacaaactgagtaatcattgaagatgctaaatatagtaaatacaatgtttaaaaccttcacaaataaatccatattaaagtcttattctaccacaaagtagctttgcttttgatataccttttaaagtcatggatttcttgatggagatattgagttgggttgttcctgttgctttttgtttctttgattttttttttttctattatataagctagacctcactctcttagtcatttcattatatgtagagacaagatgctgccttaactagagctttattccaggtgcccaaaggtcttcatttagttcctagctcaattcgtgagtaaatatttcttttccagctttaaaattttttaaatgacattgtcaggcacggtggtgcatacctgtatccccagctacttgggaacctgagatgggaagatcacttgagcctggcggttccagtctgtagtgcacagtgatcatgcctgtgaatggccactgtactccagcctggacaacatagcaagaccccatctctaaaaaaaaagaaaaaaaaagaatgatagcatttcctttacttgtggagattttctgactataacatgcacactattattataaaataatagactttacaaaatataatggttgtagtttcatttgcactaaataacgataaaccttatttaagtgcaaccttattttatatatatatatatatatatacccattaatttgattgtttttaatgtagccatggacatggagagttcacaaattataatttataaatgtattaagatagaataattgcagaatagaaggatttttaaacaatttaaatagtcaccatttctgccacccattaatcctatatattggttctaggacttattcctggagttatatcctgcacattggcttcaggcatgaaggacttgatcccacatcttctccagtgggattgtggagatcgtgtcactgctggcctgtcctgcaggctcttgtggtgatcattataaaagccagccctggggtagctcaggacaggaaaggarggatattctgaaatgattttctccttttagttaacacattttggttccagaacactgagcaaatcatcaactgaagccccatgatatattttcaaagagtgaatttctcttacctgactgaggcattttattctataatagcaattctctgggttttttttttttttcatacttataacaaagcggattaatatatactcacctaaracaccaaagatactgatggctttcaccactctatctaagcaggagtaaacacctgggaactagaaatctgagaaagaggacaacacccaacaccacctaactatggccctcgatacagtcatttaacttaataaccttccgtgagagtaaggtcattatgaaatatgctcggttttacacaaagctttaaaaaaagccacataaaatagtatatgaggtcacctctgattcctatgtaaagaagattcctcctcccttccctcattcattgttctccacactctactccacacctcccctcaccctgcaatccaacttatcaaaagtttaattttccctttccaaaagcaatgtacttgaaattcctattcttagttatgtgcattttggtttcctctttgattttcctttttttccaggtttcctgttgataccaacatgaatctcaagggcttccctttgcttcttttggaaaaaaataaagaaaagagactgatttagagcctatagggtggaaaatcacagccaggaaaaggcaggcatagcatgcagcagttcagagacagggctcacccgcccatctcttccatcagccacctccctggtagggcatcccttggaacagaagccagcaatggtcctgcagggattggagaattgtgagctctaaatgataaaacgttgagtcataggttatcactgtacagagtgatcctttggcctctgccttgagggcacgtaagccattttttccttacttgttggaatttgattcatttcctctttttctcctttagctctctaatctagaattctcagtttatctataaaaggattcaatatctgggttgatcctgaggagtcaaagggttggttttgtgagcagatgggtggcagacaatagcttttgtagagatgcctctgaatgagcccacatggtggggctttgagaagcctagtgtggaatcagtaacaaagtccaccttggaataatagtaccatagtttcagtaactgctgattccaaaaatgtttcctatcacacatcttcctcatctgcctctcacaacaatcgtgtcaggagaaagctaatccaactataaagtggctacgtgatcagaaatgacaggatgggttcattgcaatgtcaagcctcagtagtttttcatcaaagccctcaaaaaaaaaaaaattccaccccaaactgattgtgtattattcaaccagacttctggtatcttcaggcacactgtttgcaaaggccaggcatctcttatgtcctgctgtctgtagacctctgtggtttatggatgggaaaactcaaacagtctgctcttagatggtccttattgcagaaagcaggcttatgccctgtaagccgggggtatctccaaatcgtgcaggaggagaggtactgattgctcatttgcttcttctgtgccttaaaatcaccatccttgttaaagaaatgcaagcattgagtagagaagtgtcttgcttgggcttgcttttgagtaccgggaattcagctttcctgctttggaaacctgagttgggatgtaggtgtgtagcaaaaggaatgggtggaggcttctaactaatggggaaggcatctctgaaacaagctgagatgtggatctgggattctgggaatcaaataattcttcccagcaccaaactttgatgagagaatactttaatgtctgtggttgcagaataaatatgattcactctgaggattctgcactgcaattgaatatgtcagaaaaggcaaataaaaaattggaaaatttatctgtaaatagttctcaatagttttagaagagcttccaaggacattaatttcttcctagccattatttattaaaaccttcaggatagcatctcattttttggccacactaatgtagcaactaagtgtgcaggccctggattcagagctaaatctgactctttcaagctgtaagcccttgagaaatctacataaatctctctgtgcctcattaatgtcaactgtaaagtgaggaataatgatattatgtattttgtaaggttgtccgaatgtttaaattagattataatacttaatattaattgaccactttggaagtgagcattgttctaaatgctttaagtatgaattttattgtcatcgccatccatatcaattatccttatttattatgctgttataagaagctttgatttcacaaagaaagaaattcaacacttaaggaggaggcatgagaaaacatcttattgaggtttttaatcatcttctagtgaaccaagcaagactgaacctttattgcaatgttttactaggctttatagcacttttaaagggtcaggtaaataaagtcataattcaaaacagctgttacggggtggggcacaatggcattgatatcaagagactctagtactgaatcagttacttcctatttatataattaaaaaatttttttgttgttgtttgtttgttttgagacagagacagctctgtcccccaggctgaagtgcagtggcacaaacgtggctcactgcagcctcaaactctcaggctcaggcctttcccacctcagccttctgagcagctgggactataggcatgtgctgctatgcctggttaattttttatattttgtagagatagggtttcaccatgttgaccaggctggtctgaaactcctgggcataagtgattctcctgcctcggcttcccaaagtgctgggaatataggcatgtgcccacacctggcctatttgtataattttgaataaatcatttaatcttgctgagcctcaaaaagcaagctttaaataaagaataaattaaaaattaaaaggttgaattaggtgatatcaaaggttcctttcacatctatgattctaaatattactcagtatttactctgtgcagaatgtctatttccacaggctattgcttacagcacaacacagtgatcatattcctctttcgtaactagggagctgagcaccacgatgctggctactggcagagtttatccctcagcccatattaagtctagaaatgattttgtccaactgatgttttctcttcacatcagatgtcacttttttttttttttttgatatggagtctctgtctgtcacctaggctgggtgcaatggcgtgatctaggctcactgcaacctccacctcctgggttcaagcgattctcctgcctcagcctcctgagtagctgcgattacaggcgcacgccaccatgcccagctaatttttgtatttttagtagagacagggtttcaccatgttggtcaggctggtcttgaactcctggccttgtgatctgccgaccttggtctcccaaagtgctgagattacaggtgtgagccactgtgcccaggcttttttttttttttttttttttgagacaaggtctcactctgtcacccaggctggagtgtagtggtgcaatcaaagctcactgcatcttcaacttcctgggctcaagccattctcccatctcagtctcccaagtatctgggactatatccagttatttaattttaaattcaccacactcagctaatttttgtattttttgtagagacatggtctcactatgttgcccaggctggtcttgaacttctagcctcaagcaatcaatctatctgccttggcctcccaaagttctgggactacaggcatgagccaccacgcgcagccagccatcacatttttagataaaacatcgaggaagtacttatactgatatatacattttactatagcaactatagtaaagagaaaccagtgagtcctaaaactgaatttttaaaaaaattagaaacatagagttaaaattaagattatactcaaagttcttcagagataagtattaaagtcatatttccaaacctttaggcactataaagaattccataaataagaggttatttaaaattaaaaaaacctatgctcaagcaatatctttgatcataagacaattctggcaatgagacaaattcttgaaatctcaacaacactaacatgggctcagatttttgctttcaataaatagaacctcatcaaagaggtcttggaaattctgctagtcaatggaataaaataatgaatcggatagaagtcctccagccctgtgctggaccgaaatgtctctgactgcctgtcatatttcagaggatcgtgctcctcagagcagtgtggggctggcacagagatgaaagaaagaagaggttcctccctggtttctgtttatttgaacctgaatcagaatagagaggaagcaaaggagaatgaatggtgtgatccaacttttcttccatatgtgaacaatattgacttatatggcataattatgcccagatgctgtcgtgacagggtgtagagatttctgacttgcataactgaatatattttttaaagacaacaaagaaaaagaaatcagtcacaacattgctttagcatcttgagtcttggagtgcttctgccatggaaagttatagtctctgctcttttctgcttagactgtatcttaaaactagcttcaatattggatggcctattttaagggagatcctgacacttagtatccaaattacaaaagatgactaggttactgaggatctgaagattgtcccatataagttatagttgaatcttctgtggaagtttaacttggataaaataagcagagaaatgacaaatgtgttcacatatgtgaagatcatccttgtttttcttgttttgttttgttgttttatattctaggaagcacagtggaatttgaaagacagactttagatcaccatattggagacctttataacaattaaaacataggaatggggcaggaagccttattaggtggtgagattgtgagattcctctgctgttgatggagactagacagaggccagatgaatgtgtcaataatgttgcaagcactgcttccatattggctagaaatttggaaggttagaaaaagtcaccaactctatcatcataagaaaactgagttgagggcagaaagtaatatgatatctgggttttggggaaaccagttacctctcttcaaatctttaatgtggaaagaatgaaaccatcttagacctttttgagtacagaatgacttgaagtcagaggaaggagcatggcagacacagaatgtcccaaattgagacagcatcttttaagcaaattgttgtccctttgggtagagtgggaataataatatcgcactcacatttatctcacagatgctgtgagggtgtgtgactcagtgtttttaaagagctttggatacctgctgtggttaatgtgtcactcactgcgaagctttccaaggcaattattttgatcagaatgtcactcagagttagtaggctggcttcatgaatcatttggggagggtagtataattcaaatttgttatgtattgtcaaacatttaaaaagaataatagtataaaacaaaatacttgyttttacactaaaatttaacatcttttttttttttttctgggaaaatagaatgttgcctaaactgaagtccaaacaactttactttttaccttttcaaatatccatgtggcatcaagccaggccatttaaaatgacatccagttatttaattttaaattcattttgtagaaatcccacctctctggggagtatgtacagcaaaagtaaggccatcacaaaagctgaatgtcccaaagtggtgctttttagcagaaaatgtaatttttttaagatgaaacttgccttcagtgttcttagagagtgggttccatattggtttctgaaggagagtcaagcctggtctccacagtgcactaaatgcagtagggggtcaagcaaatgatgggaaaagcataaatcatcttggaattatagattcctctttgctgtttgactttaaattcaccatctgctggctgaatcttgatgggagttgaacataaacataaggccagtgcatgactgtgacgtggaaggtggaagaaagttccttctgacttgttaaaacccttaaaatctacacattattattattataatttagacaatgtctcactctgtcacccagactggagtgcaggggcacgacctcagatcactgcagcctcaacctctccagctcaagcgatcctcccacctcagtttcaagtagctggcactatgggcatgcatcaccatgcctggctaattgtttctatttttttgtagaggtgggttttccctatgttgcccaggctggtcttgacttcgtgggctcaagagatcctcccacttcagcctcccaaagtgctgggattacaggtgtgagccactgcgcccagctgacatctacagattatcatctattattcttgtatttgttaaccatgatctcaaaatgatttaattataaaactcaaaccttaaaggacaattggattccaaaatgtagattatatgtagataatatttctgttcacaagtctaggtgtacattagtatccattcagaaaagtgaaaaaaagtttaaaagcatttttaaaaacatgatgaaactataacactcaaaataatgtgatgggggataaaaggcagttgattgataaatgagtcattgacaggtcaatgctgtaaaaggccgagtctaagttgatggctctcagtcctggttcgtcactgctgttgtggaacttggcaacgagtccctcttgggaattataggcttagcatcatgctcttgctcgtattagctgcttcttctatcactctttcaacagtaacatattaaaaacaaaaacaggaaaaaaaaccctcaaaacttctcaggtaagtagtattaaggacacaaaaatatttcaggcttgatttagaactacatttatgaaagtaaactacgtgatatagagcaaaaccacaacctttaggttttggggggttttggtcttatttctctttttaaaaataagagatagggggtctcattctgtcatccaggttggaatgcaatagcttgatcacagctcattgcagcctggaacccctgaccacaaagggatcctcccacctcagtctcctgaagctagaactacaggcatgtgcctccacacctagctaattaaaaaaaaaaaaaaaaaaaaaaaaaaaaaaaaaagtgtgtagggaaggggtcttgctgtgttgctaatgttgaactcctggccctaagtgatcctcctgccttacctgggattacaggcatgcaccttgtgtctcactaatagatttgctttctaggtctttcctgtcaggtccaccaatattttagatggatggagcacttgcattagatcaggagtcaaaattctattcctgaatctattacttaccagttgtactactttgaatgaatggcttaattttttagtgactttgaattgttccagatataaaatgacaggataggtctagagagttgccttagatgaattaggaaacagtttctgagatagagatgttagtgcagtaggtttattggggagtgttctcaggaatgcctgtggggaagtgaaggatgtggaggaggaagatggactggaattcatttgccagagtcctcagcagatcctaccagctctagagctgggatggcccttcagagttatcctgatccacaaggggtcagcccctaggcattcataagtcactttgtccagtcattggggttgaccccaggaaaaggtatggtttggggtaagaggactcttcagttgagggtagttcctaggaagctagtgagctatgagttggcatcaggcaacatttccagcaatttggtcaatgagttccccttaaggctggatctgggccacggaccatggcactcactgccatattcacagcgtcgttttcagtgtgaaattctactgtgttaaagtattgtacagtcactgaaatgagagtatttttatatttggctacccatgacatttattctcttctgattatattgtttctctcctgatctagagttttagattgttttgtttgttttgttttgttttcctgtacttttctgtctgttgaggaaaaagagttttattcttctagtatgagagtttctattagtcctcctttttagacagatgaacaccctgtgacaattccttttgcctttttgtggcgtgtaaaaaaaaagaaatccataaatagagtcgttacgcaagtcttcatgagttaatttctctctccagttttcttactactttttccagttttcattttcttcaacagaaagcttcttcttctggctggacacagcggctcacgcctgtaatcccagcactttggaaggctgagggggatgtaatcccagcactttggaaggctgaactcctgagttcaggagttccagaccagcctgggcaacatggcgaaactcccaactctacaaaaaatacaaaaaaaaaaaaaaaaaaatagctgggtgtggtgatatgcccctgttgtcctagctaaaggggaggctaagctgggaggattgctagaggctgggatgttgaggctgcagtgagttgtgatcataccactgcactccagcctgggtgacagagggagatcttgtctcttaaaaaaacaaaagtttcttcaaattgcccctttacaatttaatatgcatgaacacatttctttacaaagagaaggttatcttttatctatattcaaaatcatatgccctggggatctttacatcacaatgcaaataaatgttgagttaaccaaaggaagtgtgagtaacaagttagtgactgggttagggggtggttaggacagtggcgtgtgattaagagatgaacatctcagaccgatgcttagtaaaacctacagggggaagcatgatgacctagccttgaatatctcatttaggaagttacacacgtgtctgggcttttcaaaatgtttgcatgccattaatcagcatcttacatcagcttgctcaatgaatgatgactatgtcaaatggaagtaaaacatataaggccagagaaggatgaagggaagttttttttaatgcagtaaaggataaagaaggatggaagtggccaggagtggtggctcatacatgtaaccccaacactttgggaggctgaagtgggaagatcacttgaacccaggagtttgagaccagcctgggcagcatagcaagaccccatctctgttttttaaaaataaaaaaatataaaaaaaagaaggttgtaagttattcaaacccataaggagttcagccaatgtattgaggtttcacactttagatatgatcaatttgctgtctttggccttaaaggaaaaacacaaacacagcagcctcgtgttcttctcagacattggtttctcctcctttcttcctaagacagctcttttcccactttctctctggccaagtccatgctcagcattgcgtgacttcactgttagtctaggtttattctgctctgggaagtttccctgacccccttcttgacagctgcagatcctgtcagtcacttctctgtgtgcttcccttgccttccttgtagatttttattacatcaattaggatacaccattacaatgcattattttgtataataaacacctgtatagtttctaccatatgccgggcactaatctaagtgatttacaaatgattattcttctgaccctcatcacaattctatgagagcagtctattattttcaccaatttatagaaaaggaaactgaagcatagagaattgaatacattttctttgatgtcatagcaagtaagaaaaaaggctaggattctaatccagggagtctggctccacaacaggtgcaattaaccaccagaccgtgaggcctctctgtcatatgcaagctcgtctgttttgctcagaagactgtgttttactcactcactcccaacttcttatggtaaaaattgctttttaatgatttaaataatacatgcccatgtaaaagttaaatcaatgactaaagcattctgaagaaaggaaaggttacctggaatcccatgaccctgaaataaccatcattaaaattttgttctttatccttccatgcattgtttaatgtaccacctacccacacccatacacagtaattaaatgggacaatataaccatttttttaaagaaggatggacatcatctgctctcatcctaccagagttgtctatcccaaaaagacaggttaaaaatctatgtgttttttctataccttttattctctcataggcttgtatctctcatttacgttaatggaactcattggtgtttcaaaaacatgatcatcttaaatgtactcttttagatgttgctttgctcactcagcagtcaccccatgtcacctggcaaagccctaatttatttttttcactggccacgtgacattcattccacagtgtagatgtatcacaatgcattcaggtattctcctatggtattaacttggcttctagaatgcaggggctgtctttaaccctggtgtttgtgacattgtgatgggcataatgggatcccttgaataaatatttgtaaaacatggatggaagtcagattttagaaagaataaattagttttttcttaattatgcatggatatggtcttgaatcggttctcaataaatcaaatttcagtaagggactcacttaaatgtatgagaagagacccctgtaatcaatgtttttaaagttaaatgattgtcttttacattttaactggtgtaaaataactaattattgttccaaatagaatttttgcttaaagatacgtacaatggaacgttataaaaccacctatatttacagataccttgtgctttgtgatctggcttgtatttttcctgttcctttcctgttaccctgtgtacgaaatgtatgttcttcccataaaaaaactaaactacttccagttgtgtaaacacaacagattctttcagaccactatgccttggtgtatgtcaaccctcagctaggaataacatttccatctctgtgattccattggcaatttctgctcaccttttcctaggttgaagtgccacttcttctgcaaaacttttcttgaatctcctttcctgttaccctcctgcacaattaaaaacttgcatccatttgatcccatagaatttatgctgtacttacatgacaggtacttacatcttttattttaactcatttatatcacttacaagactgtttttttctttaggacttggaatatgaccttttcatctttttcactgcagtctttttagtgtccagcatggagaaagtgctcaaaaatatttgttgagtgaatgacagtagagaaaataaaaatgtcctggattggaatcatgaaaactgtctacttatctctaatattaaaaagctcagtgtaatcttagaaaaaataatctgagagctctgacactttccagaggccacttccacgggaaaggaggagcaaagtctctgatcagaagttgrgtaaatatcctctgaggtccctgattatccagacattgacaaaagaaaggctctccaaggtttgccattattactataaggaagtcccagctcagatgattcatagttaaatatttgcatctcctctggctaagaaaaataaaagccacgacattccagagcctttaggcatgtaagatcttggtactttcccagttattgctccttagaaaccggtaactgaaaaggccctgtttcagaaaagcaagatatgtcaaatgggaaggaagtagaatagctatctggttggaattcagaaagtatatcaaggccaacaatataattgttgaaattggttattaatgttttgatactgtgacatatctgttttctgttctctaccacaaacaagaaagatgttgaaatatggcaaatgttatgaataacaaagaggaaaatacaaataagttcttttggcaaatctccgtagcaggttgaactcagactcctttaatgtcaataaacaaggctcagagtcaatgccactttctttggtggtcactttaagtgtatttctcttacaacagccctgcacgtccagtgttattattactgcttcacagataagaaagtggaggctcagaaaaataatgatccataattgatatagtggtatatatataatttatatattataccataggatttaaactgaagtggtaaagcaggtggtaatttgcagagaatgattttggaaatgctccgtagatacctctggctctaggcatataaaactattttcttattaactgaaaatttacaattacaacttgattcttgtggtttaagacaatggaggctttctacatggtgcatgcaaattttcccaaaatctttcccaaattcatttataattcagtgtgggtgagcttaccagttcctttccagaaaacaattgtgattaaggagttcacacagacaattattctgttattctcctctgtcctcaggtaggcagtgctcctcgagctttgggtggcaatccttcaccaatccattgtcagtgtgggtccagcttttcctccttaggccacaaagatagagttgctcatattttatttccaaaatatagtgttaggggcctgaaggccacaaagaagactattctgaaagctcccacactgacatcctccccagtactggaaaacaagtaataaaagagtaggaaaaaagacctcagggccttgcacataataggccttccataagtttatttcataaatgagattctgcttgacggactggcagatggagcctgagtttatagtcctgtctgttattaccttgctttgggccctgtcataacacttcctctcaaacacgtttgaaagaaatgcagcccaacataggccgtctcctcgctgtgctgagagggtcttgggtctcacaaagcaacacacacagccaggtcatgtctctgagcatcggatctagaaaactacaaagccaggaagacatggacaatgctaacatcctccctttgtccaccacatacatgcatgaaaacacacctaccctcactctccacccacccacacacacacacactggaaattgtatcatacacacaccggaaattgtacccaaaggacgctattactaactatgaagcaagtggcacccatggcttgtccagagaagacacccacagggtcagacttcacacaacaagcctatgaatgggatagcccacatttaggagtggwcttctaatccagaatcttctctttatttagttcaagataacataaacttcctttttgtaaatttgtccatcatccactcccttgctcttatactctagtgagggggaggtcagatgataaatgacaaggaagatcatttccagccgtgatgagtgagatgcggaaaacagggcagccatggagcagcgagagaacaaccaggtgtggtcaggggattccctagtgaggtcgtttccaaaaccctcatgggtagacctgaggctgtgaggaaaagaggaatccaggcagagagaatcaaaaatgaaaagtcctcatggcaggaatgagcctatttcaaaaaaaattaaaaaacaaaaaaatctgggtggcttaatgaaaaagaacaaagagacccaagaggctagtcagtttcgactggtgcttagaggccatggtagagtggacatttttttgtttgtttgtttttgagacaaagtcttgctctgtcacccaggctgaagtgcagtggcacaatctgggctcactgcaacctccgcctcccaggttccagcgattctcctgctgcagcctcctgagtagttgcaattacaagtgcccgcagctaaacccagctagtttttgtattttcagtagagatggggtttcaccatgttggccaggctggtctcaaactcctgtgctcaggtgatccacccgcctcagcctcccaaagtgctgggattacaggcatgagccactgtgcccggcctagagtggacattttattctacatacaatgggaagccatttgagggatttcagcaaggagattacatgatctcaatggacttcttatttttctttaattttatactttaaaaatttttgaaacaggggctcaccctgtctcccaggttggagtacagtggtataatcatagcccactataatctcaaactcctgtgctcaaagctatcctcctgtctcagcctcccaagtagctgtgactacaggagtacacaccatgcccagctaatgttttaatttttttgtagagatggggtcttgctatgttgcccaagctggtcttgaactcctgagctcaaacagtcctcctgcctcagcttctcaaagtgctgggattacatacatgaatgcacctggcctgaaagtactttttaaagaatactaaggctattgaatgaccaggtggggtagcagagaggaacactgtgagtctgtggcagtgtctggataagggattatgtaagtaccactaagatggctatgttgaagagtgagggagcatttagtttgtctgttttataagtagaggccatcagacttcagaggaattcagacttaaaattcatgtgcctttgaatggggaccacatacatgtcacatcacactaacactaatgtttcattgattcattctatcccttcccaggaatcaaattctgattaagagaaagaccctaagtggctgaaggaacaaaaagagttattgcaaaaaaaaaaaaaaaaaaaaaaaagctgatgcagttaggaaagggaagcctgagctattaagaaaaacacattgcttcttacatagtagtgctaaaggccaagcctgcatatccctgcaatctataaagtctgttttctctgacagtgtcagagttggaaagatcaataggtgtcactcacaccattcatcatctcagaaatgagaagatttaggaaaggagattgaaatgacttatgtggggtcacagaactagttattgttgagaccaaatttagagtcttgtctcctggatctcagtattatactttaattatttcttttttaacatgtaacccaatttgctcctaatagacttggaatacacagtgcctgaaatgtaaagatgacttactcttggccttaaggcatcaaatctgccacacgaaattttaagataagcataatacatcattggaattactcctgcttcttgtacctctttcacatgagttaccatgaagtgaactctatcttttatggaggagaggatatggaggagcataggagaaaggtaccatgtgaaagaataaataacgtctttgccttggactaagttgcattgcagttatcaccggaagttgacagctttggataataagcatggatcttttttgtctttgttggagcctgttgcccttcacctttatgtaacatctaaattctttattctggttgacatgggttgctttacaattttaacttggcatgtgtcatacgatcataggtataatattctacagttacaaaatatgtttgataagtatgaggcattcatgctcattgtgaaagccttcaaaatgtctgtacgctaggagaatggtgaaaaacaagcagtcaagtgagtctcagtgggttgttttctcagaccacgtggactctcttctcaaatctggtactggttttacgtgactttggagaatcttcattctgaatgagccccaaacttttcagtaaaataaaaaaaggattgatattttatgaaacatttttataccctaaaatgcagaagcatgttagaaatatatagttgctatcagtcttcaattaaatgtttaccacttggcaaaaatgatactttggtaaatccaaacatgcctaggtatccactctgtatactccggagaatgttcctatttaagcttattattgtcttgagcattaagcatctcacatcagttgttacatctggctttaagtctccaatgagccctggggaactcaatcccatcaaaggaatttcgagaggagttcacagctcctatctaccatagaagggagaaacaggataaggaatagatccctgataaagcacatgaacaaattaaatccattgttaatttgagtgactggcatagagaggtggcccctacaaaattstcactttttagagtcacggtggttcacagaagaatagaaatcatcttttcctcttaacattatttccatgtactacagttccctctccctaaagtggtctacttgcatttgtcaacactgaaagcaaaaacaaagttgaatatacacccatggtgcatattgttaataaagaagatggaggcaattcagtggtattctaattgtaatgataaaaacttacctatttcatcagttcctctcctttgcccctaaaccccaaatactcactttgtctcttagatatcttgaagtagagttaataactaacgagaataagcatctccatccatgaaatattttaaatatagtagtgtggacctaaaaagatagtgaaattggataggccatgaatagaacaagtcctcatgtcataggcaaacatccagaaagttgtgtgttttgcatttgtgttttgttgtttacatctgttgcataggaatgatcatagttacaacagctgacatttaatgaggacttttcatatgttagacactgtgctaagagctttatttacatgctttatctaatttaatctgtacaaccaatttattaaatgggcattttccagacaaataaaatgacgtttagtaatttcattttgattgcctgtagtcacagccaataagtattagagggaatattgcaacccagtcaactttctccagagtttatctttctgtattcctcagctggttgttggaggttgattgaaaaaccctttgtaagccttgaaatgctaaatagtctacataggaaaggcttctactattgtttctacttttttttaatggtttgtaatctcagcagggattgtgttatctaaaaatctgcttgatgaggtctgagatactggcttttagaggtcagacaggaatgactgcaagataacttgactttctccttcccctctgctgctaaggggtaaggtgggagtggttctaggacttctgccatagaactagatatgtgatggataggaaatgaaaaaatgtgccactactgcacaatgtcaagagattaattggcatttaatgaaatatctgtgccatattattttatagtgtgcaacatttaaaacaatacacatgtaaaaaataaaaaataaaacaatatgcatgtatgcatacatacacacacacacttttagctctgtcttgagctgtcatctcctggggcaggcttaatgacaggtgcaattctggcctaattcaacctcttgaaattgaaaagggttagcaccactcagtggctgctaaatcctagagggcaaaacagcctcctrtgtctcatcccttcatgactgtctcatgggagctcgatttctgtctctttccacctgctaaccagattcgattttgatgctgtaccattggtagtaaaatatacttctttctggtaaaaggagacctgagaaagtagaaatggcattatttaaaggaatttatacataccatataagttggctggatggaccagccaacaagctcaacactttgtattcattgtttcttttaatactcatttcaagctcctggattcagtatcattatctccatatcacaaagaatgagggactctgaaaaactcaagaactttcaaggtcactcacagaatacatgcctgagctgggattctaactcaaccccttaagcccgatatcctgtactttttctgctatatcaggggtcagcaaatgatagccaatgggccaaatcttacatgctgcctggttttgtgaatgtttcatggaacacagccatgcccatttttttatgcactgcctgttgctgcttttgctttacaacagtcaagatgagtgcttgaaacagaggccacatggcctgcaaagctacaacattgagtggccctgtatgagaaacacttgctgaacccaataacaatacgtgagagatgtattgttattgacaataacgaaacatgagagatgtagctcaaatcatttaactcagtgtgtctacatctttttcctgtatcttcaaaatccaacaggataggtctatagatatactgtcttaagcccagcttcttgtatacatttattttgttccaagataacgtgcagaaacccgaattccagataggtctcttataatgagtcatgtttaagagggttctattattccactttgcatttctagaacatacttctttcagaataattactttctaaacctgttcacttagcaggcagatggaaatccaacatcctttggcagagaagagagaggaattttccactcgggcaaagtgaagcactggtcagctcgtggctgaaattttttatgtcatcccctggttctacagaagactgtaaggacagaggaatgaggcatttcgccttgggatcttcagactcagatttctgagtcaggtttgaggttcctgctgtcctgtgggcagtgaggcccagggattacaccaaaggagcaggaacccaatgtcacaggtcccctaactcctgcctagttgcccaggycacataggmacaggcaggggagctggctgatctcatttgtttgttttccgtgtccgttctcaggcagtgataggcatgctatcatctcaattcttaaataaaaccaagttgtatcgttgaagagcagataaagcaaagacagaagcattttaaaaggaattttgtggcttccaaagtacaagtatagagtatttctgagttaatgaagaaataattacaaaatatttttgaaaaagtgacattttattcatagtaattcatgtaattccaactgaagtaattgatactttgtaatagtaaggacctattcgagtgaatgtttaagatactaattatatatcaattttaaattatttaatatcaaaaaggcttgaaagcagcatattttgtgtcattatgtgaattcttgctttgccatttttaaaactatttgttttctcataccccctcctctttattttttatgatgtcaaagactgtgtcagtcaagtctgtctctatgtcatttgagtttatgtttatgtgttagtgcatttttacaagttaactatccagaaacatgcacactctgggcagaataaaaaatgtctaagttaagtgaaaaccactttaaagcatggcagccaaaatagctgtagaaaagtttatgctctattatgtacaattttaatagacatgatatcttgtttcccagaatacaacagattgactatcagtcattttgtaaaaaatgaaagcaaaactaacaatcacaagagctaagatttgctggccctttgcactgtcccaggcactagtctaagtcttttgcaagtgtttcatttttacagcaacacaatacatttcctactgttgttatccatcttaaggaggaaactttgtacagaaggtttaagtagctaatcaagttttcacagctgataagggatagagccagagtccaaaagcagtctagattcttaatgccaatgctgtattgtctctccagaaaagaccactctcacctttccccttgttcttgataatacagttaaattattcatattcatagcataaattttctgtatcatatttaagaatacagttaaatattggtgcatattagaaagatttcacttaaatatgactacatgaaagtagatttgtcttttctaaaaaataaacaagcatttgttttctaaaaaatttactggcgtgcaccatttcatttcctaataattcagaataaatgaggtgtcaccgtggtccacttcaacagtagatgggcttatattcaggcaggaagcatgtcacctatacaacacagatgtgggtgattaatgaaaactaaatcatggggatgagatctttaagaagaagaaaaccaagttgtcttccagaagtgttttcagaaccccctgttttgaggttgtggatagacatgacggttttacaatgccaaaacagtctgttctaaagagaaaaagttcaatcaaccatttcacctgcattatgccgaagagctagtctttacagtcatggggctttaaaactattttgatagcctgtttgggctgcctctaaatatatcctccaaataaaaacctcagaaaatgtatcagagaaatgtacataattaatatttggcttaatatattgtcaactttgattttacatgtcccatccaacttgttaagccttctttgtggccattagtgtttactagagaataatatcatatttaattttctaattatgtgcgaaccttggagtcaggattagttgatatttttacaccttcaaatttataaacctagtatgaagtcccatctagactaacaaatgttttataatagaaatttaaatagtactccagttttgtttatgcatttgctgatggtctttcttgctatgaactttagaaactttaaatgtccrtttactcacaatacacacacagcctcaatgacctaataagcagatttgcagagccataaccttgctggcttatgtcagctcgaagtaaarggggaggtggtagtggtgaatctgtttttattactcagtgtttaatcataatgaatcagaggcttttatgagaaaccttctacatcccatgaaagatttgctgatcaaagatgtagagatttctgttttattagaaaaaattgtttagcacctcattgtggatacagaagacattgtttgttgaaaagtttaagtctttttacgctacattggatgtcacactgttctgagtttagtggtatcaggtcatcagattctgtaagatgtgattctaaaaattcagtcctagtcctaccgagtccattagagaaggtctgcagtatataaaactgtgacttaaaaaatgctcaatcttccatgcacataactgcctgatgactctcaagctcaggtgtgaccttcatagacaggctgttgtaaagtctagtaattccttcaacacaaggtaacttagtatttaaaccttgaccacacatcacttcagaattactaaaggaacttaaatatatgtcagagctcctcttcggaatataggacaatggagcttatgcagatagcattactttaattttaattgtacccatctgggttcttcgaaatggcaagtatttcgtttatgtgcctttctcatcttgggtcaactcagttccatgcactttaaaattattttaggaaagagccacatcttttttttttccttctttctctttctttctttctttctttctttctttctttctttctttctttctttctttctttctttttctttctttctttctctttcttttttgtgcatgcatgcgtgcatgcatgtgtgtgtgtgtgtgtgtgtgtgtgtgtgtgtgtgtgtgtgtctcactctgctcgcccaggctggagtgcactggtacaatcttggctcactgcagccccgacttcacaagctcaggtgatcttcccacctcaccttagcctcccaagtagctggaattacaggcacatgtcactacactcagctattttttttttttttttttttttttgtatttttagtagagatgggattttgccacattgcccaggctggtcttgaactcctgggctgaagtgatcctcctgcttcaaaagtgctaggattacaggtgtgagccaccatatttggccaagaaccacatcccagtgctgtagaaaactccaaaaatttattttgcaattcaaaatataaaagtttgttagtagacatttagtttgttagatatttaaatctactagacaatctattatgtattctgctcagaaatggttaagacctactgatctagaagacggatctctctgagccataatttctgctcaaggcttgctaggggagatccttctaacttggctttatacacaagaagctagctcacaaaaatgtcggtattctagtagctatgcstttcattgaccagacctgagatttggcctctccatcacttcctctgcaggtgatgtagacatcatttctgctgacatctatgttgatgcagttctagagtcatctgtgtccctattatcctgaaaatgaaaattgatagcaaaggcagataatgtccatttagttctgggtgtaaatgtcttccttgctcttccattgtgcaagcactttatgatttgagggagtaatcaggttatattccttctgttggccagaagtgcctgttgaagaaagacttggctctgttggtctggaagctaactatgtagactgatccacagaggactccatattcatcttcttgatactgagggcttcatctgtgagttgtaagcctgtaaatcctctgtttcagtggtttcaaagttccaagagcaggaggaaaatccagactgcctctgctgctgtgcagagcaattagacagtttgagtgcctcaactgttcctatacaggccagtggagtcagagccttaaaaagaccctcttctcccagtgctttctcaagtaagtacagcaacctcaatgtcttatagtatcactacagcacaatacatgagtagttttacatttgaagtaggattaaattaaaagtaatacattcacatggtaaactcaaaagtatatggccaggtgcagtggctcatacctgtaatcccagcacttagcgagactgaggcgggtggatcatttgaggtcaggagttcgagaccagcctgactaacatagtgacaaaccctgtctctactaaaaaccctgcagagacggccaaccccatctctactaaaactacaaaaattagctgggcatggtggcacgtgcctgtaatcccaggtagttgagaggctgaggcaggagaatcacttcagcctgggaggcagaagttgcagtgagccaagatggcaccactgtactccagtctgggtgacagagtgaaatcctgtctcaaaaataataacaataaatgtatatatagatataaattatatattaattctatattttatatataatatatactataatttatatacttataaattatataatatacaaatatatatttatataaattatatacctataaattatatatataattatatataggtgaatatatacagatgaatagttatatatgtagatgaatagatatatagatggataattatatatagatgaaaatatattcacatgttatatgaatatataagtatatatttatatataaattgtagatacataaattatgtgtaaaattcacatgaaaaactctctccacctcattttaccctttattccttctctttaaatctgttgaccaaaacaaatcactgttaacatttgttatttaggggtccagaaatgttttgtgtataaccataagcatgcatatatatacatatcaacagctacatctagatggtccacttactacagccccagaatggaaatttcttcctcaaagcaaacattagaggcatcttctgggaaaaaaaaaaaaatctatatttatctcattctgttcttcatttaattagcataatccctgttggatattttcctcaccaaataaggaacctgtaattaagtgttatattacatgtgcttatttctcttcctggaagtccattttttaaaaatatttttaattgatatagcatagttggtacatatctttggggtacatgtgatattttgatacatgtatacaacatgtaatggtcaaatcaaggtgactgggatatgcatcacctcaagcatttatcttatctttttttttttttgagatggagtcttgctctgttgcccaggctggagtgcagtggcgtgatctcagctcactgcaagctccaccttccaggttcatgccattctcctgcctcagcctcccaagcagctgggactacaggctcctgccaccacgcctggctacttttttatatttttagtagagatggggtttcaccatgttagcccagatggtctcgatctcctgacctcgtgatccgcccgcctcagccttctaaagtgctgggattacgggcatgagccaccgtgccyggccaagcatttatcttttctttgtgtcagcaacattataattcttttcttctagctaattagaaatatgtaataagttattgttaactataatttccccactataatatcaaatactgtaagttattccttatatctaactctatttttgtacccattaaccaactgttatttacccctgctcytctccttcccagcatctgataaccatgatttcacgctctatggagatccttgctttgatgataaattcattaaggacaagaaccctgcagggtgttcaatatgcttcccaggtgccaaatagtctcaatacatattaacagaaagtcagtgtcaactcacctgcacctcacacagtaaattgatttaggcatctcagattcctaaactctctaggttaacacctcatatagtaatgaaagtataatcagttcacatgattgaaatcctctctagtttaatgtacttgttgcttttccatggactttgaaaacatgaaggtctgtagccgtgttgttgcttttccatggacttggaaaacatgaagttgtgtagccgtgtgtctccagacttttaacagcccagaaatggtttcaatgttctgcattaaataaatcgagaagggttagacaaaacagtgtctgaaagatttcatgctgtgagggtgatgagggtgatgggtgacattaatgaatctgaaatggtcrtgactacaaacttgtttttaaaatgtcactttctctaagagaacaaaaacttgaaactcaatgttcatgaatacaagaaggccttttcaaagaaaggccacgggcactctcactaatacacacttggcatttgggtatatccctaagctgtggactgtgtttacatatattactctttcttctcatcactctttaaccaaattgttgagtgtccaagatgccacatggtcaatggattattaccctgtggattcaaatctgttaccaattactctaggggtttattgagtggtcctgcacacccactttcctttgtttttctaattatcgctgcacagctaatcctagctcaaaaaatcaattcctctctcatatctacttacatatcctctttaagccccttctgtgtttttttgttttgttttgttttgtttttgttttatctcacttccatctatttcctggttatttcaggaaaagttcttttcacaccactttttagtggattccatcctgtctctcttcttgtgaccataaaataaaatttgtcataaacaaatgtaagagtctggatgtttctacaaacatttaagtggcaggaagaagctaaagccatatttttcagtcaaaatgttagcagagattttcctgcactgtgcatgatttattttctttctttatatttttagataccttataaattgtctaaaatctcaatgaacaacatttatggtcaaataacataaagaaaaatcctttatagccacttacttactcaattgtatagtgttttgacattctaactacactatcagtatggttttctgttataacgtagtataggtatagattttagccacatagtaggtgaaataggctatgtgttaatctagactaagacacagccattatctataacatatattttatgagaatttgcattccaaggtaaaaacaactgtttgaaaagttaccttttaaacaaatccagttcatatggtgcattactttcattttctgaaggtgattcatatggaagtattgagaagagaaacatcatagtttaaaaaaggccaatcagactttgaggacaagatccaaacattatgcaactttatatcttagcagagtgcatttagtaggtgttcaataactctttgttggataaatgactttatgagtaaatgaagaaaacctcagagctattggcttcctgtgccttgaattacacttttgagtgggactgccttctgcaagccagttgaaaaatagctattggctcacagagttcacctttattttgaggactctgtcaagacaccttagtgcatgttcctagttatgtgaaagatatgctgccaatcagaatcccaatggtctccttgtatgtttcatctttaaatggggctgcgctgttagggacaggatatatcttggcagactacatggatatgaaaatttcaaatcttcccatagtcctctatctttaaggaaaatcatggcacttgtttttgaatttttttaatccatcttccagattccaaaactaggaattccaaatgttgtttggacagactgaaaagagaacaaccaataggagaagtggtacactatgagtagtcaaggtaccatacacatgggaagtgtgaaggagacttacttagtatttwcttatgtctctttgccaatatttgggagtttcacagagcatttctagataatgagggatggaagtgaagagtaggacaaggtattcaaagatctaagaagaatgagaaatcctcgatttcccatatgacaggatgacttggttacacgagtaaaytgctttttgtatgtgaaacaggcagcaattggaggtagcaaaggaatacacaggtaagccctggagtccaattcccaaaattagtggtgttttctgattccctaactgactctatggtaggctcctggtcaaaagatccatcagggctgctgggcccatgctgacattccatatagccatcttctttctgattctctgtcttccagtgatgatccagctctttgcagcagcaggattgtggctggccagaagcacacttgatttcaaaatggatgtgacgggcaggtcacctccttttctgcagaagtgtacttgcatcaacaaatctttttcctctcaggttttgaggaaatgggatcaaacattccaacacagagaaataggaggcgtgggcagcagctctcctggatctctctctttccttgaggagatcaacttgtaaaagattacaaaatgtaccctaagtggtcctagagcaccctcctatcttctttcccaagcttgtcatgtggttgcagtggacatggaaagtaaacactgctataaacagagaataataaattgtaagaaagcaccagaatatccttcttgcttgaactttgaatcattagatccaaacattccccctctctcttctcaaagttccaaagtgttaaagagttttgttctccggtatcaggagttggccacaaatgctttctctataagttcataattcctgttgggaaacttggaaaagagctctccccttctcatccaaagaagtgatgacttctctttgttagtttacaactaacaaagtcccatttctggtttgaaagtcagatggaccttggcttatatttatttaacraagacgtggaatttctctaacagactgaaagtttattagaataacatctagcattaggcctggcaaataggaggtcctcgttaagagatctgatcagatttgacttctaatcccagatataaggtgtttattctttttgagccactatttcctcatctataaaataagaaatattcataactattccataatatgtattcttatatcctgtataataaaataactaatataggaatataataaataactaggaattataaataatataagattgtaataaatatccaaaatcaagggcctccttgaatttgttatatattgatttgttgattttttgagggcagtaatcaccacgtctgtccagatcagcgcggtgtccacgccccactcagcactgtgccttgtccatagcagatgctcagtcaatatttatctaatcagtgctgtttgtattcaaagagaatgtttaacttcttactctttccattcccacctcccctttttgatctcatgtccactatcggtgtactgaggtctcctgggctctgtttgcaggaatctaaaagtagtttttttactttggtactgggacatgtaactccactttttagagaaaatatttcatgctaattaaaacatctcagggctggtctccctgcacttctcactttcacacctacatactcataccccttttctctttttccttactttgtaatgctattagagttgacagaatacttgctgcttccccagaaagtcttagccaggagttcatgaaaccctgtcaggccttgtgaaatgtacagatgtgtttcaaatgatccataaaccctgatattgtataaaatgtgtgtgccattttatggaaagaggatgatatgttttcttaaccaaaatctttcggggtacttcggtccataaaaggctaagatccactccactaatgagcaagatctagtcatttagaaaatcctgcactctctcctttgttactgcctcaatttccttaaaaagctcttataagataataaagaagccctctttacttcctacagttccactccacagcaataccagcttaagtgtgtgccttccagcgtccatcccatctctccgtctgaggggtccccactcctagtccacccaggccaggaaacccataactcatatgtaccagaaaacctcctttttaaatttcctcatgcttcctggcaccctgacctgacaatggactagtacctcatatccacttctaccatgacttctgagaaagtggtattttttaccacagtgaacttggtatatgcagtgtgtgtcaggggcactggccttactaaagtagaggcccattctggagaatagtaagaaataaggagcaatacattgatgaaatagaagggacattaagtgatggtcacagaccactcttaggactgccattaacttcagatgttaaagaagtgcttcagctctctgtgctttgtcttcttcttgacaagtgaggatgttaggattatctgccatgtcatccagcttcaatctctataattgtataaatctggttggcagtggactcgttagtgcaaagtcctaaagccttaaagatccgaagttttctcactgggcaagcaatttgcgggattacgacagtgaacttggtgtatgcagtgtgtgtcagggacactggccttactgaagtagaggcccattttggagaatagtaagtagtaaagagaaatacactgatgagacagaagggacattaactgatggtcacagaccactcttaggactgccattaacttcagatgttaaagaagtgcttcagctctttgcactttgtcttcttcttgaccagtgagaatgttagacgggattatctaccatgtcttccagcttcaatctctataattgtataaatctggttggcaatggactctttagtgcaaagtcctaaagccttcaagacccaaacttttctcactgggcaagcaatttgcgggaaattaaacaagtccaaaatattgaacaaatgaagaaaggggccattttaacagacaggaatacttcataytgtaaagatggccaggtgtagtggttcacacctgtactcccagcactttgggaagttgaggcaggaggattgcttgaggctaggagtttgagaccagcctgagcaatacagggagacctcatctttgctagaactttaacaattagctgggcatggtggcatgcacctgtagtcccagytatgccagaagagaagggaggattgcttgagcacaggagtttgcaactgcagtgagctatgatcttgcaactgtgctccatcttgggtgacagaatgggaccttgtctcaattttttaaaatatatatatacatatatatatatatakagagagagagagactatatatatgtgtgtgtgtatatatatatatabagagagagagagacagagagagagtaaagatctcatttcctccacaaatgttaaaaacattattctgattttaaaaaaagaatgaatttttaaaatttacaaatttctgaaatggacaaaaatatcctaggccttcttcctcaaaaaataataaataagaataataagaaattgcactggtatctgaaaaagcaacttaaagctataaaaattaaaatagcatgttatgccatgaaagagacaaatgagatagattcaagtttcaaaataacaattgttattattatgatacaattatattaattttgtacctataatttaaataaaataataataaataagaaaaatcactgaataaaggtaataatttaaataatttaaaatcttaaaataatgattatatgtataataaaactgtaaatttacaattatagagctataaacaattttatagttgtaatattttgtaactaatgaaacattatattttaatgattttattattgttgtaattaatataaagaagataaagaaaaatgggcaaggtttgaataagcacactttgtygaagatatatggatagccaaaaagcatataaaatatgaccaaaagcctctggtgtttagagaaatgcaaattaaagctaaaatgagattcttctaaatacctatcagaatgtctgagattaaaatgactgactgtagcaactagtggcaggaatgtggaggaactgaagttctcatacactgctggcagaaatgtacgatgacacaacccttttgaaaaacattttggcagcttcttaacaatttaaatgtacatatcccatgtaagccagccagtccactcctgggtatttactcaagagaaatgaaagcctatgtccayacaaagacttgtatgtaaatatttataacagctttatctgtaacagctaaaagttggaaaccacccaaatgtctatcagcaggtgagcggataaacaaattgcggcatatacagtgtagatagtggaatactactcagtaataaaaaggaatgaacaattgacacatgctacaacatggatgatgcaaaataattacactaagtgatagatgctagacgaaaaagagtacatactggctaggtgtagtggctcatgcctgtaatcccagtactttgggaggctgaggtgggcagatcacctgaggtcaggagttcgagaccccccaggcccacatggcaaaaccccgtctctactaaaaatacaaaaattagccaggcgtggtgatgagtgcctgtaatcccagctactagggaggctgaggcaggagaatcgctagaacccgggaggcagaggttgcagtgagccgagatcgtgccactgcactccagtctgggagacagagtgagactccatctcaaaaaacaacaacaacaaaaaaagtgtacatactgcatgatacaaaattctaagaaaagaaaactaatctatataaaaatttttctctgttattctctactgagaggggatgaggaggattaccaaggggcaaggaggaccttttggaggtgatagatgtgtttattactgggattgtgttgatggcttaccaggtatctatgtaagtcacaactcatcatatggtatactgtaaatatgtgcaggctgggcgtggtggctcatgcctgtaataccagyactctggaaggccgaggtgggagaattaaggccaggagtttgagacatagcaagatcytgtctctagtaaataaataaataaataaataaataaataaataaataaatgcacttttttgtatattgagttatatctcaatgaagctgcttttttttaaaaaaaaaaaaaacatataacataaaagagattaacagaagagattcaaaagtctagaacaccaaatattaaaggtagcttttcaaatcagtgagaaaataatgatattacagaaaatggcaaatcatctagaattaaatttctacttcatactatcagcaatataaattgcagactaatctaaattaacaatttaaaagataaaagaaactatagaaaaatacacaattatgtatctgttcttgaatggaaaaagattttccaagcgtaaatacaaagaaaaatttatatagtaaaacaatgattgatttaatttgataatttttttagaaagtttacatcaaaacaaattacaaaattgaaaggcaaatagcagtctggttgtggtggctcacttgtgtaatcctagcactttgggtggccgagatgggcagattgcctgagctcaggagttcaaaaccagcctgggcaacgtgatgaaaccccatctctactaaaatacaaaaaattagccgggcgtggtggtgtgcacctgtagtcccaactactcgggaggctgaggtgggagactcccttgaacctgggaggtggaggttgcaccgatctgagattgcatcagtgcactccagcctgggtgacagagcaagactcccgtctcaaaaaaacaaaatggcaaatagcaaaggggataatatttgccacaaatataaaagaaaaggatatatccttgctatataaaaaggtcctatgaaacagggacttagttggatatttctatttttaaaaaggcaaatcatataaacaagtgttttacccacccatcccccctcaaataaagaaaaaagacagggatggagaaagaagggggaaaaaaaaaactgagtaaaaaaattctttgcaaaagagtaaaaaagagatttgtttcctcaccttgatgttgtctttataagttgttttattttaatcttttgtttttccatattttcagagttcctacaatggacttgtagtacggtacctgggtgatcacaaacataatctagggagtagaaaagaagttcaatgactcagcatagtgttaatggtcttccagatgaaggaggggacatgaacatgtgtctgtcccaataaaggttgagacaaggtttgttgtgcacgtgcgcgtgtgtgtgtgcgtgtgtataacagtgaggagactgtaattagcaggaaaaattggggttttgaaagtagaccacagtcttgtcattgtaccatgactcmccaggaggacagaggacaagtaccctactcctgtgtaaatccagactgccaagtagagcactgagatttgatgagtacttaagaaatgcttgcttgattaattggtaaaagatattaaaggggaagattttatatcacattcaaacatatgaagagaaatgttaaaaatgtttaaagttccatttccagtctcactttccaattcttggttcaaaatacaaggggtaattagacatcgactgtgtagtcaacattatgatcaggctatataaaatcatgaaacatcatcctaaactttaaagaactttgagtttagctgggaaaatatgctcacaggaaataattatgtaggaaaagaaggcatcaaaagggcttaaagcaaccaatcacacagagtttccttgttgggaccccccccccacccgccgggccccaccccgttgatatcctaaatgttctcttgacatcttggatttaccatagagcctagtactgtctgtaaggtcctgggcctgttctaattagtgctgagtatctgttgatctgctacgtgcaaatgggaagataaaactaaatgttagattagggtcaatctttaaaactctttcctagattgtgatggtattcagtggtggttgaccatcatggaattgggagatatttgtgaatgtggctgcaggctgcatgtcctttgtgtctctgactcaagacacacccattgatctcatttgtcttcatttcatcattgggcagaatgcgttctaaaatgaagagactaaaaccttcacagaagcacactctttcaacatctaaggaaaaattgttgatgagaaaactgtgagaacattaggaggtctttaaattgcaaggggaaaggtctgttggtgaaaacagctgaaatcctatggattaaatcaacttgtaaataatgtattcttagagtctgcagtgatctcataggcatgtttaaatgctgtttcttatgactacagtttaaagtcatggtatggactttcagtttcatgaggctggcctgggggaaaagagcatgaggttgaggttgatggtgttaactagagcaactgagcccccatacagaccttctgaacttgctcattaacgaagccacaggatggaaattgtatagtgtccttgaccagagcattagttacaagttgtgagaagagaagaaataagtaagaaagaaaataaatgacttataaaaatcctcagaagatatagtccccaactgttagcacaaagaaaggatgtaaaatcatggaggacagcagtggagaagataacgttagcagacaataaaaggccaaagttttagaacagtagtaagtgtttaagaatatacataatatatcttcctccatttgctttttgtcttcaccataaatagacatgagttaacgtatgtttaaagatttatttcccttttattgagctcacccaacaaaagtttttttcatcatgtcctgcttttacaaaccaagatctaatttgacatgattacgtaattgtgtggccatttgtgcccttccttctcctcctcctttctctaaagtagaaagcctctctttcctagagcctatgtaaaatgtgttaattcgcttaatagcaataataattttcttatgacaatttatctattcactaaagtgttattaaggacctattagttggaagcctctgtgccagctgttgggaatagaaaaatttataagacactgtctttggagctttcaatctagtgggggattcaaacaattaaagagatacttttaaaagacagtgtaataagtactctggaagatgtggcagactgccagttgccttccccagcataacattttcccaatattcattaggaaaagaaccctttaattgtacccaattaaaataccgaatctcccagcctcttctgcagcagatgtggctgtgtgactaagttctgtccaataagatataagtatacatgtttggtgagatttccaggaaggatgctcaagtggrgatgactaagtcagaagaaagttccttttagctttcctgcattcctagaattctgatgcaaaagctggagctacagcagcaatcctggactatgaggtaaccttgggagtactagggaattgggatgctagtaactttctagaagcaccaactcagccccagaatgcctcctgctgacttcttttacgtgggagagtaagcatttgtgcatttaagccactatagttggatatttgaccattgcagacaaaaataagatcaaccgatagaatgccatttatgaaaaaaaaaaaaaaaaaaaaaaaccatgggagtggttctcctctctgttatgatagggagaggtcagagatgctgtccctgaagaagtgacattcacactgagacttaagggagaaatgagtgagcaaggtataggaaagtatttaaggaatatcatctgaagctctgaattagaagctatctacaagatactaaaagaagatcagcatgacagaagtacaggaattaagaagaacatagtaggtgacaaggctgaaaaatctcatagattctccattttgcagagacttatagatcatcttcaagatagtaatagctgcagagcagaaggctagagcagagaaagaactttgagagataccaatatagacatggtttctaaagtcttaggagacaataagattacccaggaagagtatttaaagtcaggagagggccaaagacagaaccttgagatccaacacttaaagatcaagaagaagagagtttcctatcttctgtttcttaaaaaataaataaataaataaagcatatcagcataattcagagtcacaaattctaagaaatcatggggcagagggcaggggtgaggtagggtttgttttgttttgttttgttttgtttgtagataaccaaaggaagaaacgattgatgcaagatttcagggagggtgaatagccctccttgtagctttgccctgctagagagatggtgggtggacaattactataatatttacaaacaggataagtctacgtcagcccctaacattctcagtttcgttatttgtaaaatggcgtaatgatacttatcttttagagttgtttgaagagtacataagagacggaaaaggatttttaattagataaggaaagcataatcacctatctttgattcattcacccttttaaactgattaaagcttagaaaataatcacatatgcagattgatcttagtttgtccacctcttgacaatcagttagtagtatatatgtatttttttatttttaagaatttttatatccccatgcattgactaatcttgccccatcatagataagactagaacaaaatattgctttgagaagtccttgagttccaaagatttaccatgaagctaatgaaacctgcattgcagagtccttcactagtatggccttttccaatgtcttgaaaggagtcctagtcacatgttcacatgcttacacatttatgtaaaatatgcaggataagataattaaactacaattatctaagatggcagtctttttttcactctgattttctgtccaaaatattcctcttgtggaagtaggtttggaatggccctgaacattttyggaatctgaactgagagaaagttgagtgaaagatacattgatttaaggcatagtgagatgtctagtaaagttattgtaaggtattccagtgttgaaaaggcttccagaaatatgccaaaaccgactgtgctgactcacatgatgtcatgccagaaagatgaagggccagagattgtatgatgacctgagtttgtccttgtgcaacaagcaccaatggcatatgagtgttgatgggacaagttttgaaatgtatggagccaaaagctagcctgtggaaagttctaccaggcattcgacatgtggtaaggtaaccaggagactaagttccgtggatgtctagtcaaatggaaattttcttctctcaagaataaacatgataatttcgtgtatgcaattctaaattcaccaaattgtgttttctttttcaatggcaatttcaggaaattaaatgatcagaatccccatgtttccaggggccaaacctgtaatagtcccacagacagtgagtgtgtctataacaactaatataggcagaaaaattcaaagacgttttctgaaatttgccaatacctgtaaacatttttaggacattgtcaaaataagctgtgaagctgaaagaagtttatttaagtattaataataaaaatttaataagctatgctaaataccaattctctttctattatctctatagaaaagattttacaaaatcattctcagatgtagaagcaatttttaaaaattcagccaaaaaatagtagggtgaaaagtattataatgatagcaggtagttaattaatagcatgttctttttctgaattttatgatgcttgtggctttgacaactttaaacattttataattgtggaatttcttttgtcgttttacagaaatattcagttttgtacctcataatttgtatttataattttgtattcttcttcataaaaagggccattgaattgtgtttaactcatgcctcaccaaacctgaaccagcattttcctctgttgaatttctattgcctgcctacagcaaggcccacgtcttcctgtaacagttgcccccagttcccttaactatcaccagggagtcagcagttaatgacatgctcaaccttcctccaattacagatggttaggagagaaaacaaagccataaggccattaaactcatgaggttttgactggtggttcggaggtagagctggccctggctatatctgccgtgtacacaagaaccaaaaataccacacttcatttcagaagatccagatttgatcccacctctgccactggtgtatgatcttcagaaatgaacttggctgtccgaacttcaatccccttattcatacgatagacctattgtgatggccggcaagctgaggtatagaaacacatattatatagtaaggggttcttcaaatgtaatatctgttctcaattcctcttctctatcattaccaaggagccaatgatgcacagctacccatgtaccttcattgtagagacacaccctgaacaagcagacaacatggcgccacatcagagtattatattagaatgtgtgtttggcatttctttagcagaggggccaagtgtaggaagggagcgggtagaaaaggaggaccacaggtgacaagagtctcccctgaccttaagcttgcagttcccactgaaccaaacagaagccctgtatgcatctggaagtccttgcttagtgggctgtgcaatgtgtgttttaggggtctcaagccttcatcccatgtagccatggacaacatgttccaggaaaacattacttcctcacttcattacattccaagtgacatttctgcatcccttcttgacgaatgttgtccaaaattggttgtccctctctttgatccagctctgaccacagagatcagttttacatacttgggtacttccccttggtgattcaagaggaggcactttccttaaatagccttggaaaccttgagacagctgctgcatccatctatgttcattgctcaaacttcctgtatggtttgccaccaggcttaggttcaaatccaaaatcaaaatcttaacatggccacccaggcgcatgtggcctcagtaatacacagtttttgagcttcatctcaagcttctcttccccttactttgctctccatgcctgcttccagctcttctgcttcacccagtccttccccatccctcatgtcacacaggttagcttctgtgcccaagtagggtcctgcttcctttcacaaagctgactcccatgagctctccagagatgatctcaagtgtcacttttgtggggataactaccccagtgacaccctcctccagatttggttagcttctcccattccagcctagtttagatggaatcatattaagttgctggcattaatttattatgacctacaaaaccatcaatagtgtacagttctcacaactcccttgtacattgcagccctcatcaaaattgttatgaagtaattgatttgaataatgattaatatctgactccctgatggtttataatctttgtggaagtagacaacatatctatcttgtctactgctatttagcacatactaaataccacctagtaaatatttgtttaatgttacttatttaactgcagagatatactttttacattttctacatttaagatgcacacggaatatgcgatgttgtggagaaaagagctatttgccaaatggttacttgttactttatttttctaaggctttgggcataaaatgccattatggaattactattttattacaatggtatctgtagtactttggccctaatgttcttttttggttatgatgctgcactatgcctgtggaatacattctggatgcatgatgagactactgagacaatcacaatcttgtaagtttccttttcttctaagataaatctcaagcagagattctcttctcaggaagagtagaacttttcacaatctcgagccaagtaaacactctcaaattgcaatgcaaaagattttgcaaaatacttgaaaaaatgcaatttataaagcagaagttgtacagatgccatggaagatctaatgaaaaatcagaaaagattgcagcacagatttaactcttctcaagacagcaaaagcaccccacatgtgacagatactcatgagaacattgggagcctgaagccccgttttccagacaaggaaggaattacgggtctctgatcacagcagaggggccctcattagacccatcaaggattgcacgtgccctgtgcaaggccacatgcgcatggggtgtgcaattaactctgcccatgctgctgaagtttcagtccattagtctgagtgaatcttggtcatttgtatccctcttggtgcctcataaacatatgcctcatagtctgcatcttcaaactttttccatactgtaaaactgtcttcgcaaaatctcatcacaagctgaaaagtgatccctggtgataaacaactgagatggttattcacctccatgactagcctttcagggcctcactttctatatccatcaaatgggaagaacaatagatgcctcatcctcctcactatgttgctgtgagcatctgttgaagtagtggctattcragtgcattgaaatgcatcagtcagtacacagatacaagggcttctgataactcatacctgaagaatttttgtcaaccctgaagggatttgcttcttggtatacgggtattaaaatactagtataatttctctaacgggagtatgatgtcactagttccagagtcttttcatagatggatgggttttatgataaataactcaccctcrgtgttaacttggctttccaactagccaaacaggcctttgtggaacaaggttagcaaatagcatttgggcaaacgatcaaaagggtctccctctcttctatcactctctttatctctcttggtacctctctctgactttctctccctcctttaaaaagttatctctgttttttttaattttttttacattaaaaacaacaaatgggcccttcagaatagtcgaaaactttagaatgcaaagatatcaaaaaataagaaataacctagatcagaaaacagataaatgattgccaggggttgggattgggaggagttatttacaaggtgaatgaagaaattatgaggggttgtggracttttctatattttgatcttgaaaattatataactatatacttgtgttaatcttgtagaagtgaacactaaaaagggtgaattttattataaacaattttttaagagaacaaaaaatgtactataatcccaccagccaataacacactattaacactttggcgtacttctgactagtctttttttttttttttttttttttttgctggtgtttcaaaatgtcattatgatcatataatacacaaatatacatatatgtgtgcatatagatatctacagatgactaagatagatgattgatagatgatagatcagtgaatagataaccaaactcaaaacaaaatagttaattcatgcaacttgcacaaaaggtacaagaaatatactatgaaaagtctccctctcccctttttccttgggcacctagctagttttgttttagtttttacctagctctcctgagacagtgtgcatatataagacaaaatatacatatacctcttttgtaatactaagacaccaaattcatacttctgcatcctgccttttttctttacttaacaatacatcttgaagatggttcaaattacacatatatagataatttttcatgactgatttttaatagctgcatagtatttctatattttaatgcactgtaatttatgatattgtattgacaaccacccgggttgtttttaatatttcatttttacaaataataatgtgataaacatccttgtacttgtgagatttcttttcctatatgggttatttatctttagtagagcttcttagaattggaattgtgaagtctaagtccacattttaagttttgctagataaagctacattgccccctttaaagttgtgccaatttttactccaactactgatatatcaaagtgtctgttcttgtatcattatcaaaattttaatatttaattatctgatgagtgaaaaatgacatctgatagtcctgtcagttagtattgcttttaatgtgactaatttttagcttttattcatgtttaaatgaataaaatgtactccctttactacttttttttttttttttttttttttttttgagacagggtctcaccctgttgcccaggctagagtgcagtggcgtgatcatggcccactgctgccttgacctccagggctcaagcaatctgcccacatctgcctcctgcctgtgttgctcagactggtcttgaactcctgagctcawgcagtctacctgccttagcttcgtaaagtgctggaattacaggcgagagccaacttgcccagccctgtatttcctttactttgaactgcatttgtgtatccttggttcatgttctatttgatagccatttcttcttaattagagggatttcttttttttagattagaaaaactagcccttttggctatgataagtggtttatatttccttttgtgtgctacttgccttttgtctttatttggcttttttttggacttgcattatttatttaagatttacgtagytggatttctttctcctttcacatatggcctctctcacttcaatattatgtagaaaaaaacctctgaaataatgaattcctatacttttatgggttctttttttattttgatatttgacccatctggaatttattttggtataagaatgaggtagattttcaacaatttattccactaaatcataaattagtacaccttttttccataaatggctaaatagtaaatattttagacttcatggatgatacagtcttggggcagctactcaactctggccttgggcgaaaaagcagccacagacagcacaaaaaccaatgggcataactgtgatccggtaaagctggtgtagacacacaggcagcaggaggatttgaccctcagattgtagtttgctcacccttggtgcagaagattacttaattattctaacaaaattgatttagtaaataattttccccattgatatgtcttggttcctttataatacacaacattattttttataggtaggtcttgtacaaaactctccatttgattttattgttctgtctttctattcataggctgggtatgacactaatttggttactatagctttatgtatatttttaacattggatgaggtcagttgctcctcaaaactcttatttttcagaattttgtgcaggaatatctgagtatttctaattagattagaatgtcagaatacattcatggacatatgagtttggggttttttaaaattttttttagatatccttcaccttgaacatttattatttctttgtgttgggaacaatccaaatctctcctagatgttttgaaatatacaatgtattgttaactgtagtcaccctactgtgctattgaatactagagcttgttccttctgtctaactgtatgattatactcattaaccaacttctcttcatctgccccccacctccacccatctcagcctctagtaactaccattttactctctacctccatgacattaacttttttagctcccatatatgagtgagaacatgcaatattttgtctttctgtgcctggcttatttcacttaacataatgacatccagttccattcatgttgatgcatataacagatttcattctttttatggctgaatagtaatccattgtatgtatatacacatataacgtctgtatatataatgtgtatataaaatgtatatccataatatatgtatatatacacatatatgtaatatatatwgtgtgtgtgtgtgtgtgtgtgtgtatatatatatatatatatatatatatatatatatatctcacttttttttttgagacagagtcttgctgtgttgcccaggctggagtgcagtggtgcaatctcagctaactgcaacctccacctctcggttcaagggattctcatgcctcagtctcccaaaaagctgggactacagtcatgtgccaccatatccggctaatttttgcattttttagtagagacagggttttgccatgttggtcaggctggtcttgaactcctgacctcaggtgatctgcctgccttggcctcccaaagtgctgggattacaggtgtgagccaccgcatctggcctcacattttctttatccattcatccattgatggacatttaggttgcttccatatcttggctgttgtgaatagtgctgcagtaaacatgggagtacaggtatcattttgatatactgaattcctttcctttgggtaaatatgtcatggtgggtttgctacatgatatgatagttctacttttagttttttgagaaacctccgaactattttctacagtggttgtactaatttacattaccaccagcaatgtataagagttcctttttcctttttccacatcctcactgacatttattactttctgtctttttgataatatccatccttactgagggaaagagggtatctcactgtggtttcaatttgcatttccctgatgattcgtggtgttgaacttttttttttttcagatacctgctagccaattgtatgtattcttttaagacatatctgttcattcctttgccctctttttagtgcttttacatatttggcttttgtttttttgttttcgttttcattttgctgttatgttgttcctggatatacaaggaactcaaactatagtcctttgtcagatgaatagtttgtaaagattttctcccattcctcagattgtctcttcactatgttgattgtttcctttgatgtgctgttagtttttagtttaatatggtcccatttgtctagttttgttttttgttgcttttgaggtcttagccacaagatcttcgcccagaccaacatcctgaagtgttttccctcttttcttctgtagctttatagtttcaggtcctaaatttaagtcttcaatccattttggtttaatttttgtaggtggtgagagattggggtctagcttcattcttctacatatggatgtccagttttctcagcaccatttattgaagagaccatcctttcctcaatgtatgttttcagtgcctttgtcaaaaatcaatcagctgtaaatacatgcatttatttctaggttctctattctgttccattggtctatacgtctgtttaaacaccaataccatgctgttttagttagtatagctttgtagtatattttgaagacaggtactgttatgcctccagttttgttttttgctcagtattactatgagctatttttaaaaaatacttccaaagaaaaaagtgcaaaagtttatattagcttactatagttttaataggttaaaattagtagcttctgagtaatgaagagagactgagcttaatttctcctgctttgaaagtacttctagggtctgggtgtggtggctcatgcctgtaatcccattgttttggaaggtcaagacaggaagattgcttgagccccagagttcaagaccagcctgggcaagatagcaagaccctgtctctaaatttttttttttaattaggcaagaatagtggtgtgtacctgtagtcccagctacttgggaagcttgagcccatgagtttgaggcaggagcacgctatgatcatgccattgcactctaatttaagcaacagagtaagtcctcatctttaaaaacaaacaaacaaaacaaagcaaaacaaaagaaagtacttctatttatttcttcacctgctaatttagcttgttcaagtgtagaagctggaggatgtttccctgcaatgacagagtagccaattttgtatctcctgattttttccttctctcattcttctttgctcaacagacactaaattgaggtttgtgtccttgtaaatagtagatttcatttaccctctgccacctttgtcaaaaaataattttaatttaaaaaatgatgtaaacttattttagcaaaattgaagactatagaaagctatgaaagtgaaaatttaaatcaccgtaacactgcactcagagataaccactgttaggacttttatttctttctttctcttctctatacacctgtaacatgcatgtacacctactgcatgcatatgtgtatgatacatgtgcaaacagtgcatgctaacattttctaccctgcttttccatgtgttatttttatcctgtgttccactattttggaaaccgtcagggttgacagagggaaattgatcaagccctttgtcttcattgatgtcaagagtttcagtcaacttggaggccgtggcctcctccttacaggcttcttcagcctttggtttgagtttgggttttttacttttcatttttggaggagccacgttctctctcctttcctattactggagagccgcttcctctcttcactcattcattgtgcagtgtgggggagtcaggacccagatgggaaagaaagcatcttgccacactcaaatctcatcttttttgccatgtttgccccatggcatttctctcagcatcttcttgtgctttttccaaaacatataaaggacaattctactctggaaagtcactgggatactgttctctgagaacaggtattgagaagaagatggtttcctcttggaacttggccaactggctcacagcgaacgtggtgtggactcttaccagctctctctagtatgctaagggcccccaaccagggaccctgaaggcatctcaagagagcagtgtccaggtctgcccttgttggaaggaggatgatgtgaggagatcacctttattaaagctgcaggttgtctgccagattttcaaatttcaatgtaactttttatttaaccaatgctgattaatagtagtggcattgttgaaatccattccccttcatttcattttctaatgaaatttcggatttctacacagacatggttttctggcataaaaagcttgcatttgcaacctgtcatattgggactgtgcagaacttttccatgttttaaaactcaggagaaagaagtaaagatggtaagagtgcacttgagcagaaacaaagggctgtgatcccaaaacaggggacaaatgagctgcaaaggagagacaccaagagcggagagcaagaggcaaagtgatatgaaagactccaaagtgctggttcagagaaaagaaaaaaaagggacataggtcaggaaaggggagaaggactgacatgaactggcaaatggcaacagatataaaaagccagctttctctggggagtggaaatgtttctaagcatttttgttcatgttagtatgatttgttttttcctaagtaagcttgaaaatcatagagtgaataggagaaaccaaagattagggaaaatatttttagaacaagctcagggaagtcatataggtttaaaatatatagtctatgcaaataatggcacacatttcagaatggaaacaaaaataagtggcagataatgtgtccaagtaatattggtagcaaatggactgttacgagagcaaatgatattttgcagagctgagagtgtgacytgtcttcaattatttgaatccctatcctacaaaagcattgaaaaaggaagatctggagccaatgactgtgtattacatatattttcattcagtacaagcagacatcatcagtgtgctatatactactttcattattattattatcttaattaaagctgtctyacgagccaggcgcagtggctcacgcctctaatcccaacactttgggagaccgaagcaggtggatcacttgaggtcaggagtttgagaccagcctggccaacatggtgaaaccctgtcgctactgaaaatacaaaaattagccaggcatggtggcaggtgcctgtaatcccagctacttgggaggctgagacaggagaattgcttgagactgggaagtggatgttgcagtgagccaagatctcactgctgcactccagccaggatgacagagtgagactctgtctcaaaaaaaaaaaaaaaaaaaaaaaaargmcaacawcaacgacaaaactgtctcatgatgaaatgggatgctttcactagccgtggttgctcatgcctgcaatcctagcactttaggaggctgaggcaggtgaatcacctgaggttaggagttcaaggccagcctggccaacatggtgaaaccctgtctctactgaaaatacaaaatttagccgggtgtgctggtgcatgcctgtaatcccagctactcaggaggctgagacaggagaattgcttgaacccgggaggcagaatttgcagcgagccgagatygtgccactgcactccagcctggacaacagagcagaacactgtctcaaaacaaaacagaacaaaaaaagaaaagggatgctttgtggaacagggagattacttgcactggaattgttcaagccaagttctatcaacatttgacacagaaacacaygaccatcgtaaggtctttcccagctcagcattctgtgactgcgtggtctttgtactgagttttacatgatatggatttcttaccttagaaggatcagtttttaaaagatgggctgaatgaatcaaatcagagaacactatttgcctacccaatatctagtctccacagctagctggggacactttatagccacgttaaaaaaacaacagcaaaaccccactgcatttctcaacttctgtagcagatggaggtggtcaagtgactaagttttagccaaagagatattagtgagaattgggagaaactttgagattccttaagaagggagacagaggatgctaacatggaacttgtcctttgccttcccattctcctttctgccatctggatcaggatatctggccatgctgaaatcatgagacaacatgaaggataaaatcctcaaactaagaatagaaatcagaacattaggacctggtctgagttcattgtggagcttccccagcccgctcagkctgcccccagtcttcccatttttagaaaaattaaaactatggtttgttaaagcttctattctgatggtctctgttacttgtagctgaacgcaatgaattgtgagatacgatttaccacaatttttttctttctttctttcttttttcttcttcttcattttttttttttttttwttttttaaagggttgtgccatgtcacccaggctggagtgcaattgtgcgatcatgactgactgtggtgtcaacctcccaggctcaagcaatcctcccacctcagtctcctaagtagctgtgactataggcatgtgccaccatgccaggctaatttttgtattttttgtagagatggggtcttgctgtgttgcacaggctggtctcaaactcctggcctcaaacaaatcctctctcctcagcctcccaaagtgctgggattacgggtgtgacccagtgtgcccagcgctgtttactgaaatttttttttttatgattctgactatagctttaaacccaggctctgccatctccatgctgtttaacaagttctctgcccttcgtctgcctcaccagatgtattatgtataaaaaaaagtcacaacctagattgcagaatttcatgtaaatcgcttacaaaacaacacagatagaaggcagcaattggtgagtttgatctttggtgcccaaatacagctgtgctatttggtgtatacaaatgtcaccaaattcctgcacaaatttgcgggcgggataggggaagaaggaagggatgatgaaggcaatggacacaacagtctaaaaagttttaaaaaattgaatgtaggtaaaatagagctcagaattcctccaccatcatctgcatttgaatctggggagaagtcagccctcccaactttcacttcctactagaatagcaagacacactctgcctccagacagtgtggattatctgccacccgaactgaagtttcaatcactcaaatcctggtgtcatttacattgtttctactgggaaaggtcaggtgtctgcaggggctataagcaaagaaaaacccatcccctggaaccaccagtgtaaaggagagggaaggcgagtgacagcatgtgtcgatgctggatcattttcaggggtaacagaccactacatcctgaggctttttagcaaataggaagctgaaggacaaacatctgaaggagaaattaatctccgtgagtaggtgacaagctgcgataagcccttggggtgtgtgtcagtgtagcacagatgttagtgtgagaactattacttgattcaagggaaaggggagaagggcagggaggggggaaatgacaatgaaaaacaaaacagtgaaaaccacaatcatcttcaccaggcagctgatttttttaaaaaggcatatatccatcaaaggaacaaaacattaaaatacacccatatggcaaagacctggtgtaactggaattttcacctcctgattttgacagtgtaaatttgttcagcccttttgaagagcaatttggcaatgtgatttcagagccatagaaatatgcacatccatctttcaaatgtcccagctcttataaatgtatctttaaaaagactcaaaaataatttttttaatttatatgcctgaggtgtttatttcagcatctctacaacagagaaaaatgaaaaccgaaggtttgacatttgagacaatattaagtaaatcaatacatgctaatttaatgggatggtattaagtaaatctaagaccagcctggccaacatggtgaaaccctatctctactaaaaatacaaaaaattagccaggagtggtggcaggcacctgtaatcccagctactggggaggatgaagcaggagaatcgcttgatcctgggaggttgaggttgcagtgagccaagattgcaccactgcactccagcctgggtgacagagcgagatcctgtctcaaaaaaattaaataaatcaatatatggtaatctaatgggatgctatgcagcactaaaagtatattttaaaaaaaacttgagaaatgcttctaagatgaataatacacaattaagtcaattacmtgacttcaaatattattataactgcatgtggacaagaagacaaaaccttcaaggaaaaaaagttttgatattatgagattatgggtaacattgtattcccagccttgaatttctgttattgttactataatatgtgtacaatttttttttagtgaagtaaaacaaacaagtaaaagaaaggttgaaacttcacaatgtagagatcaaccagcctgaacctctcattttacgggtgacaagttgaatacaaaacttcggtggaattgaacgggcttatttcagtggaaatagtgagaaatactcattttcccaagtgcctattagaggtgctgtcattttccaggagccaatagaaaaacacataaaagcagtgcattggtgtgatctgggctgtttctctgaaatcactcagctcgctttcaactgctgcgttccacaacacaatgtggttctacattaaccacattacatcataaagagatcattaaatgactccttatggaaagggagggaagaaatgatgtttagagaacctggtagtatcggaggcatcatcctccttctctgctgcctatctgtgtcgcactcactcttgaggttatgcaaagaaaatgttgacaatttaggtgccagctgttgtttgacgaatagcaaataaatgactgtgaagtcctttggaaaacagagcaaaaccaaattagtgattcccctcttctgcctcccaacatcttcacctccagggccttctttacactgactatatttcctctgatttcattgtcccaatgagacagtaatcctactgagagaacagatagggttcttggagactagaaattatgtttattgaatggttaaggcattgtttttttatcataagctataatttaaagttactaagaaaacaggccaggtctctgtaatgtagggaagcagagatcagattatcttctgggggatagtggaggagggttgtaaccaccccaagtccttgagtgaggatggaacctagggctcaacagcagaaccctaagaacggatatttttgcctaggcctaagaatgtcatcagcattttatttatttgtttgtttgtttattgagacaaggtctgcctctgtcacccaggctggagtgcagtggcgaagtcttggatcactgcaacctccacttccctggctcaagtgatcctcccacctcagcctcctgagtagctgggactacaggcacacaccaccacacctggatatagttttttttttagagatgaggccttctacattgcccagtttggtctcaaattcctgagatcaagcaatccccccaccttggctcctcaaagtgctgggattacaggtgcgagccaccgtgcccagcctcatcagcatttttagacagctacccctctgtgrtactctgtggtgagaaataagtttaagagataagtatgcagttatgaggaaagrtgatagaaccacaccatttttatgaataatatactaaaatatattcttaaaaaacttgtcagttgtatatttgataatagcatatttttacttagtccttattaaagatctcgggaaattcaaatctgtttcatctttgatcaggagagaagatgttgcccatccttagcccagagttagaaaggagaaatcatgtgattggccaaggtggtgatgagagtctcttcagaagggaagacttccagttgcaaggtcaggtgacccaatcaactgcctttgaacatctggaaaaatcttctaaaactcttccttctcaagaagtcctgcaactggagctactaatgaaagctctttccagtagcccttacagctaattttctgttcacatatttgtcttctgctgtaaagagctgtgcctcatagtgtattaagggctggcttttcctttcattgtaagggactttccaccacaaacacaaggccaycatggccagcaatgcacaaaacagcagagtatggtcggcccttaaagacaaggtttgacttactcctctcttctcttttttacagacatgtttctctactataaacttcactcttagctttattttcaagaataaaatatttctgttttcaaattggcatcttacgattcagcagactaacccaagaaataattttatggaataatcatawttcaatatcttatttcttttcaaaggaacatttaaaagcttataaaactaggtataacaatgaagctgtaaaagaaagtaagaaaacacaatcaaagttaaaatgaaccaagctaaaaggtaaatataattattggtgttaggctccatatttgcctacaggcttcctaatattcagagcaaaatggaaaacaaactgttatcctagctcaggtcacagatcgctctggccattcccttttatctgccctgtgtgctttcttgggctcttcttctgttaacaggactctttttttctttggggaggttcttctccaccctctgcctagggctgtcaatcaatgtgccccatcttctacccttctgcataggacccccattcccttgacatggtgattttccagaggatgggtacctaggtacctggccaataagagttcgagatcaataagagtcttcccagaggttaatacatatgctttggaatggagtttattgcccactaaagatgctaagctggaaaaatataaattgggrctatccattggctaaattccctgccctgaggagcaggcctgtctccagtgggaggaagaaaactgaacagaggagaattgcaaatggagagagagcaagccctgtgtactgagttctggcttctgtccctgaggccctgaaacctggctgctgcagcttttgattctgaccatgatccaagagtccttccaagcagtgagagcaagtaaattccattctttgattagcaagtctgagtagaactctgccacttaaaacaaaaaaagtccaaattaatacatctttcattattggaaaggaatcagaatatcagtttaacaaggagcccattttattttctaaaattaattttgaaagaattttctcacatgggacttaatagcgcatattgactgatgtaatggacaatgccctcaaccacatttttacagtaaatgcagaagcgaatttcatctgatggtttctagtataaaccttgaataaaagccaagggcataacattaaagcaaaattgagttaaagccattttggaagaattagcccagtgcacatagagtgttcaacatttgagtggctcaattcacccaagaaagcttcaagaagttgaaggacactttttaactttgacagctttcttcatgtgttcctttgtttccccatttacccaarcttctgataaaggttgaataacaagtattttgagattctaattttcaaccagagctaacattttccactactaagtgagaaagggatctaaatgcttcagagactgggggaaattagaggagagcaaagttatgctacttgtatctraatataagaccacttgtctctgcacagaattgacccctgtgggacctttggggatacctgcaagatatgcaggctgtttttttctatcaataaacyttggattttcaacaacacaaaaacacatcatcaattagatccccagagtcatgaaccaaaacagttttcacatgaaatttattcaaagtaaggatttgtagttacctgttgtgatatgggaaaaccacacagcagcttggcttccagtgtgctttccagagtgaattagttttaaagtgtttattttctttattccctcctccccaatttcacccagtatctgaaccaatgtatccatcaaagtagtgtaatcagagagtctgcctagaaatgtattttagttaatcatggctaataccaagcccttctttctcccagaaatcaggatgatgtccctcttggaattacttttgatttgtgactggttttgatcatgattacacttccagtacctggcgtaatacctagaacaaactcccagtaaatatttgccaaactaatgatagaatcagatttatattttgaaatgagcactctgaatatattctagaaattgtattggatgaacacaaaagtagagtgggaatgcagatgaaaggctctgtgcccacccagaggagggccgcttgtggcttaattcaggcagcaataatgggaactgagagaattgagctggtttgagagatatttaggaggtcagttggtgttatgaaaagataagggagaaagaaggaacaaggccagctagacatgttgtggggcccagtgggaaatgaaaatgctgagtctctcattaaaaaatcattaggaatttcaagagggtaatagtagagcaccaaactgtgcattgtacaggacttttactcataaagccagctctaagaataaaacatcctatattcattatgcccggggygcttccatttactcactgagtgcctaccatgacagccactgtggtaggtacttaattctacctaaaagcaataatacaggattaggatagaagcccaaatgaagaagaaaccaaacatagctccaatttatagcacctaagagcattttcacctgtaaggaattttttctatttttacaggaaaratcaagggatttgccctgattcttggagtacttaagtgcaaattttgaagcatttcaattgttgaaaacatatctttttttwatatactttaagttttagggtacatgtgcacaacgtgcaggttagttacatatttatacatgtgccatgttggtgtgcttcacccagtaactcgtcatttaatattaggtatatctccaaatgctatccctcccccstcccccaaccccacaacaggccccagagtgtgttgttccccttcctgtatccatgtgttctcattgttcaattcccacctatgagtgagaaaatgcggtgtttggctttttgtccttgtgatagtttgctgagaatgatggtttccagtttcatccatgtccctacaaaggacatgaactcatcattttttttggctgcatagtattccatgrtgtatatgtgccacattttcttaatccggtctatcattgttggacatttgggttggttccaagtctttgctattgtgaatagtgccgcaataaacatatcttttttttaaaacttagcatatatctatttgccatctcctgggtcaaaaagccaatggaaagctcaatgaaatctccaaatattcttaggttcaccttgacagatttttttctgaagagcaaaagagactataaaaaaacacttatcaaacatgagagattatgccttaaaaccacttaactcttatttaagatactactctgaaatatgtagatctgaaaacagggaagattaaaactcattttgctaatgagggcttagcccttgaggactccctgggtaaaattgtattatgggcattatctgggtccacactctgccctcaataacaagagaataaaactctcctctggtcataggtggagaattagcagcaccttgacattttgaaagaactagtctatcaaaatatataacagggttgtgacaaaagaatgaatggaaaaatcctctggtaggggtaattgcatatgattgatataacaaattatgattcagcatttactgagctcctacaggatgccatccattgtgtcagatccttctgcatgtgcactgagttaaattctcactgtaagattgacatagaccttatcactgaagatattaacaaatcctatcagttgagggaaattcaggttatgagaggtaaagtggtttatccagggttgtgtagctggttattggcagagccagaacttgaagctcgatcaactccacctataggtcaatactgtcctaagatttctggatacaagtttctgtattttcaaggacttcgttcatgggatttccccgtatcatgaatacctctctcttctgaatcatccctaatgcttgtagacatgttccaatatccctcaccttcaaaaacaaaaagaagatgaaacaaaaccttcttccttactgcactgctgttctcatttgctctgctccctttcacagacctacttcttaaaaaggcatttgtcatcaccatctccactttctcacccaaatttatttattacctttttgcttctatctccacattgccaaattcagtcacttttctgttcttattttattatgtctctggcagtatccaacaaagttggccattctctcctgcttgaaatactttttttaataatatattttgtcatctataacaccatatatcctcggtcttcctcttacaatccttttcggttttcctcttaccatctcctcgtagattcttcttctggaatacttttgccagttcttctgtctttgcttaacgaataaatgtagagtgtttctggaaatctttttctatatgctctttttaggtgacccctccagttgcttggccacctgtgtgagccatgtatctatgactctcaagcatagtctctcccctggacttcagacttgaccacccaacacccaaccaccaccttgaaatccccacttggatgtccagaagatttctcaaacttcacactaataaaacagagtcctagatttctctcctccaatcctggtccacctcccctgtgcttctacatctcagtaaacattaccactctccacttaagaaccttaagacagaaatctgaattattcctttttacttcctcatcaccatactaactcaatcagtatgccctattgcctctacctgtgaaacatctaagtccgttcactttttaaaacattttttaagttttttgttaatgcataataaatgtccatagttttggggtacatgtgataatttaagacattcatctaatttgtaaagataaagtcagtgtacttgggatatccatcaccttttaaaagtatttgtctttttataagctagaaacattcaaattattcttttccagctatgttgaaatgtacaatagattattgtaaactatagtcaccctactgatccatgtaacgctagatcttatttcttctatcaaactgtatatttgtacccgttagtcaacttctcttcatggtcacttttatacatatccatttctttcacccaagttaaagttactatcctatcctgcccgggctacacatggtctcctaacttcaacctcattggtctctttcgatttcttaaatataccaagcagattctttccagcttggtgcctccaaggtaactgtttcctctacctggaacactcttcccttgatccttgcatgatttgctttgtcttgtcattccatgaaaataacttttactctgaaaagccttagccaagcccctaaagtagccccacagtcacatccactctcctgagcacttgttaccatctgattatgtttgttggcttgttcgtttgytgactgtttggaatataagcttcacgagggcagctgtgtaccctgttcaatgggacatcctcaacacggaggcagggcctggtacagcacagtcctcaataaatacttgataacaaaataaataatttatgttgcattttggaataataattatattcttagttacacattagctgtatctagaagactgataatactgggggaccaaattaccttttaaaattatatttaagcctactaaacaacaacttctgagttaacaatattaagacaaataaagaatgacatggctcacaattataaatcagctatggttaaagatactcttaaatagtaaaaaataatcaagaaaatgttatggatttggcctctcaaattatgaccctgttgaactatacaaaatataaacaaagaacaatatctgaaacattattgaaatttactttataactgaaagttagtataagcagttaaaactgaaagtaaatatagacaaaataattgaacatatttgacaaaatatagacatctaaaagtgaaaagcattttaaaagtgagaaaactcctagagagtttgaactattatatggtattttcacctttagattatgaatagcatgaatgagatgataacaatggtaataacaataaattcactataagttcttakaatttagaagataccattctagaagctttccatgaattatctcattaactattactgcagtcttatgaagtgagtattatgatcatttctaatcttatgcatgacaattgagatttaaagagtataactttccaaggtgacaaatttagcaggtgtcagaatccagttctgtcagaagaaataagtagaaaataaaggtgggtttgttggcgactagataatcataataaacattgatataatcgtttataatttttcataamcgtagaaattatacaacctgtgtaaagccaaaatactttggtgatttctgggttcagaagataatgccttttgtagctatggagcttagatcttgtagctatatgtgtttgactgagggaagtggaaattctctaactgggatatcataccaggatgatgaattacctgtgcaaactctcactattgcaaggtcctatctacctggaaatataagattaaggtttgcaaatccacttgggtaagtgtgtctcaagattttaacctatttacttataataattttcgtatttgccacctaagttttatacacaagactaccaaggaatagacataagttgcaagtggtcacagcttgacctgaaaacctatatcagtaaaccagtggagctctccttagaacagtaaggaaaagaagtgtaagatatgacttcagctgatacagtcagcaaatacttcttggatctatctgtcccatacactggtccaggccctggaaattgagcagaggtcaaataacccacttccctcatgaaacttacattgatggaatgaactactttttatatatttaaaataaaaataatatgaaaacttgaggtaatgaatgctgggcacagtggctcacacctgtaatctcagcactttggaagactgaggcaggaggatcatttgaggccgggagtttgagatcagcctgggcaatgtagcaagatttcgtccctactaaaaaaaaaaaaaaaaattagatgggcatggtggcacatgcctgtagtcacagctactcaggaggctgaggtggaaggattccttgagcccaggattggaggctgcagtgagctatgatggcattactgcattccagccttggtgatagagcaagaccctgtctctaaaagacaacaacaaaaacttcaggtaaaagtaaacctttctttcctttcatgtcagagaccacatattgcaatgagagtgaaatcacatgaaacttataaataaaactgcccttctatcagaatgaaagaaaggacaggaacaggtcaacttggttattttctctctagacccgtcattgagggtagccaccagagggctacctagccatacctaggtcacatacctaagtaacctgatacaaaactttctcctacctcctcctttttcccacctgtgaacctaacaccctgaaatttagcatctagaagtatctaaatgaagacagacatataatttttgcccctgagctcccacccttttggactggaattggacatatctctggagccacaaatcagagtcacatagatgtgactgccagcttttgtgacttggactcagtatctttttactgcgccaccttacgtttcactcagacaccatctggtgatggattggtccgtcatgcggtatcagtctgcagaatcatcttcagtactttaaggacagtgcagactagaggaaagattccaggttagatgtcagctatttgccaattagatgacctgggtatgtaatgagaatgcatagccccacttcgtctggtaaattgggactgtaattcttactttgtyttagcccacaggatgatatgtatagaaagtgagttataaactgtaaatgaagctgggcacagtggctcacacttgtaatcccagcattttgggaggccaaggagggaggatcacttgagcccaggagtttaagatcagactaggcaacatagggagaacttgtctctagaataaaatagaaaaacatagccaggagtggtggtatgtacctatagtctcagcaacttgggaagctgagctgggaagatagcttgaggggaggagttcaaggctgcagtgagttgtgattgcaccactacactccagcccgggtgacagagcaagaccctgtctcaaaagacaataatattataaataaataaataaacaaactgtaaatgrtacaaatataaaagagcaatactaacgacaaataataatacatataatgaatgcattgataatgacagtgaaagttagaagtgattcttttagcacagagataagagattagctcatggctcaggccaggcctcacagattatctgtctcctggtgggactaatgcaagatctgaagtttggtctgtaactttgtcattttggtttgttctatggaccaaactctggagtactgattaacatcattgtctagcagttgaaagctctctgataaccttggrgagtgctagatagaatagatacaattttgccttttgattttcctttgcccaaacaagtggttcacatatgaagatgtcttttggaagggaaaaataaaaattacagattcccatgtaatagggaaactgagtcttaaaatccaacaccaccatcttatttctaagtcgtttttacattagggcttgttataaacctaggttattttgttttgcctacgtgtaaatcttgatggattcaaaaattccccaagtaacttagtgagatttcaaaaagrtccttgattttagcagcgtttttataaaactgtcagttacagtagataacaatagcaattctattctcctccattttaaactggaatttactgattcaaatttttaagagaaaaagttcctgaacttgtccccttattctaggggaaaccattttggtgcctgtctatagctacttatggcctctctctcttgttttttgagacggagtctcgctctgtcacccaggctggagtgcggtggcaagatctctgctcactgcaagctccgcctcccaggtgcatgccattctcctgcctcagcctcccgagtagctgggactacaggcgcccgtcaccatgcccggctaatttttttttttctctatttttagtagagacagggtttcaccatgttagccaggatcgtctcggtctcctgactcgtgatccacccgccttggcctcccaaagtgctgggattacaggcgtgagccaccgcgcctggctggcctctcttttttgaatgaggtaaaaaagaagcttgagaggcaaaacaaccaacagcaaataaccctagtgtattcattcattctcacactgccataaagaaatcctggagactgggtaatttataaataaaagaggtttaaatggctcatggttctgcaggctgtataggaagtacagtggcgtctgcttggtttctggggaggcctagggaaatttacaatcatggcggaaggcaaaggaggagaaggcacgtcttacatggtaggaacagaagcaagaaagagagccaggaggtgctacacacttttacaagaatttactcaccgtcacaacagtaccaagggggatggtgttaaaccagtcaagagaaaccacccctatgatccatcacctcccaccaggccccatcttcaacactgggaattacaatagaacatgggatttcggtggggacacagatccaagccatatcacctagtaatcatcctcaccttcagttaaagcagcctgtgtgtttactrawgaaattagctacttgacaccaatcttttcagcaatactgctgtcagataagagaatcattgagtaaaatgccattaattgcaaataataaaacgtcattcattcaaatcacgtaatgagaagtttgaattctgtctccaaaaccaacccttacttttgtttatttatttttacctagtacccagggcatgattctgtctatgctgtcataggtctttagattttagttgccattagcaggcattttcattcaatttatttatttatttagagacagagtctcactctgttgctcaggctggaatgccgtggtgcagtcatggctcactgcagcctcaaactactggcctcaagcaatcctcctgcctcagcctcccaaatctgtggaactgcatgcatgtgccaccacatctggccctggaatatgattttataagaaagctgtctctctattaaagttttatgcraagaggaaaactaaatcagtggacagagctaagagttagacracccagactttcctccctccgttgcctctgtttctgtctttgcaaaataaggaaatttgactagcttatctttaaaacctctacttgctcattctatgatggtgccttgagatggagattcagtgagagattcttgtttcagtgcttttatatatttaacaaattttcaccgagtacctattacgtgtcaggacctgctctaggaaatgtggatacaacaatggacaaaacggacaaacctatgtcctcatgtagtttacattctaaggcctataaagtattgtctatttgaacacataaaatgtattctcccagtttgggcagaaacaggacttctgcaaggcctggagaagtaaggaagactgaagcaaatggaatccatggcactttccaattttgtactttctctttctgtctctccttactttcatttcttgacctactcctagacccatgcagataccaaattttacaaattttactaccagcaaatagttatctattatgcagttaaactgtgctatgtgtagggatgcagagcaaatcaagacatagcatatgccttcaagaagccaatgatgtccttgtgagaacaaaactcacatatgtaaaaaawaattgctagttcaaaatgtcagaggctgagaaccaggaatatggcctgaacagttgtgtgctctatcaggagagattcactaaaagttagtagacttcaggaataattttcagtgcacataaagcttgaacttaagtaacataggtagttttcagattttaaaagcaattttcagtaaatacaagtagagatatggcctgcaaaataagagtaggatatagcaagacacatttcttattcttctgacaaggtagtacacagttcatcactttattgacaagatttattgatgtgactattgtgatgtcatcaacaatggctttgaagttcagaacatgagaaagagctaatggtagggactgacttgaaagcctttgcattctaagaatgatgattaggtttctaatgtattattaaataatgtccagcccacaaaaaagatgaagtctgcaaaggtatacacaataactctgtgccttgctatggtcctatctgatctcaaacaagaagctctttgggttgtgttgctggtggttggatgtgttctgagccatagctaggcttatgcacataacaaagtctgattcccaggaatctttttaggaaacacctcccagattaagtaatatttacctacttgtcctctttgaacagtgctcctactgattctttaccctaatgaagttcatgtcccaacccacacccttttcctaaaacaattaagcttttagtggtgacatgatgaaaaagaaaaaaaaaaaatagatgcaatggctgacttttggaaagttcccagcaaaaaaaaatcccggtggctttctgagtctcagcatgtttcttcttagttctgtgtacactgagataaaagtagagtgggagactgagtttaccacctgtgctaaagcagcagctgttagcattggtgacattcattgttacatggatatcaattgagctgggattaggaagccgcctgtctcctcaagcttgttacgattcagtcacttggaaaaaaacaaaaacagactttcggatgaggattctaatkcccaggtgacctgaaagccaggttcagcgtagtcaatgagcaacatgaaatgaaatttccaatcagaattctcattagccttattcagcactacccagatggatgttccttttgatgtctttgtcatagcagcctcacctatgcaaatattgccagtattaccccttatagtaagttgaagaacttttaagggttgtgaactttacataggtaagtgaatcaagtatacttgaagagcctctctgttgacataagtaattagattattggacaaagatctgatctagtaattttcttagtatgtatgtgtgccaaagccaagagaggatatgttattaattagcaagcaaaatttctaacgtaggggttttcccacatcttaagtaaaattctcgaaacctggaactatggctggctctctggaggtgtttcataaatgcttgctgaattaatgaatgtatccacaggcatcttttaagtggctacaatgacattaagaagaaataaggtcacagagtgtagttgccgcctcaggctctgggaaggatgggtctggaaacaaccccacagtagaccatacacattgtttttgagactttcagctcatccatttggttactgattacaagacggtttttttttttcgtctcaaaaaatgctttatttctcagaatcccatttcagcattattggtttttccctcaccaattctattttcagctttctgccttttctcataatgacctgtaggtgataaattagtaataataaaaatcaataaaaaatgataaagttttttttgggggggaaataggaatgagtttcatgttaagaaaagaaggaacgttccagatggaattttctgtaatgttaaatgtacccatatggcttctgggaaatttaggggcatccttttgtattagggtaacctaatgccacctgctttaaaaattcatattaggaaatagccacattttgaccttcttgaacgatgttcctttatcaatcaaaaatataaagggtgttttatttattagtcattgttgaaatccgtaatctctttctatcgccaaattgtcttaaaacgtctgtccagcacatcattgcaaccttgactgtcccttccactgtgtgttgaagagtcacaggtcccagggggagctgcgaagaaacgtaaaccaaataccatttcagtaactgttaagggacaattgtgacgattttgtaatgcttgrcatgttttgcttataatcttgtcctacaaagaagcctatcagcagagatgagagatttttgctatgcaaagattagattaatattgatatttgcagaactgggttcaacctgtgggagacctagtcgcaggtcttgtagaatttatagcatattaagaagatatttaaatatttggcttcagtgtgatggcctcatttctacatacctttctaatatgtgccaactctctcttcttcatttcacttgtccgctgaaagatgagtcatcaagtctggttgaacctatctaatatctcttgaatcagtatgtctctgcatctgtattgccatcaccctagttctggccatcctcactgaccacctgactttctgcctaaatggtctcctactttctggtcttgtatactttcaaccctttctctgcaatcagagtgatattgcttccartgttgtacagacaattcttacaaggtcctgcagcttttctttcagtctttctttcttttttttttttttwttttgaaatggagtctcactctgtcacccaggttggagtgcagtgggcgcgatctcagctcactgcaacctctgcctcccaggtttaaacgattttcgttcctcagccttccaataactggggttacaggtgcatgccaccatgcccagccaatttttgtatttttagtagaaagagggtttcaccatgttggccaaactggtctcaaactcctgacttcaagtgatctgtccaccttggcctcccaaagtgctgggattacaggcgtgagccactacacccagctctttcagtcttactgttcgtcatttttttccctcccctttctgcaccctcttcactctgctttcccattctctatgcctgggctacatcttaaaagacgccatgttctcctggggtctctggtgtccctgattctggaaatgctttcctgtctcttctctctamcccatttcacttagataagtcctatttatccttgagatttctcataggtggcagtctttttcccataagacttttcctgttctagacctggtggctcacacctgtgatcctagcactttgggaggcacagccagggcgaatgaacccaggtgtttgataccaacctgggcaacatagtgagactccatctctacaaaaaataaacaaccaggcrtggtgatgagcacctgtagtccaggcatggtggtgagcacctttagtcccagctactcaggagsctgaggtgggaggattgcttgagcctgggaggtcaagacttcagtgagccgtgatcatgccactgcattccagcctgggcaacagagcgagaccctgtcttaaaaaaaaaaaaaaaaagaagaagaagaagaaaagaaaaactttccctgatatatttaggttgagactagacaccctcttatctgctcccacaatgcccacgtcctccatcactgtactgaccatactctggtaattggctgtttatctgtccaatgccttccctagaccagaagctcctaaaggacagagcctgtattcccattcgtagtaccagcgttcagcacagtagctggacctgactaagcaccaagtaaatatttgttgaattaagaaaattaaaaaaaaagtgagaagtcaacagtctcttaatcaattgtaaagaaacactttactaggatgttctgacagctactccaaagtatcaaatattttaagtgaaattgtgatgtctggtgacattttttcaatattttagatttcttacacacaacttattttattttcatccactgaagctctcaagcatcttgttaaaataaaataaattagcttggtttctgtatgtgtgtgtgtgtccttttttggggggaggggggctggtggcaggacagggtctcactttgttgcccaggctggagtgcagtggcaggatcatggctcactgcagcctctacctcctgggctcaagtaatcctcccacctcagcctccctaatagctgggattacaggcatgcaccaccatgctcaggtagggttttttwaatttttcatagagacaggttcttgtcatgttgcccagtctggaatatatatatttttttgacttttattttaggttcagtgatacaagtgctggtttgttatatagataaactcatgtcacggggatctgttgtgcagattgttttgtcactcaggtactaagcccagtacccaatacttactttttcttttcctctctccaccctgaccctccacgcccagatagacaccagggtctgctgttcttgtccttgtgtccatgtgttctcatcatgtagctcccacttaaaagtgagaatatgtggtatttggttttccattcctgtgctagttcactgagaatgatggcctctaactccatccatgttcctagaaaggacatgatctcgttcttttttatggctgcatagtattccatgctgtatatgtaccatattttctttatccagtccaccactgatgggcatttaggttgattcctatatattttttaattgacaaaaataataacccacagaatcactaagtaggggaaagatcagctgctgatattttggatgtacttttctcgagtccaaaggataattcagtcaacttaaaatagttatttaaaaatgtgaacagaatttgtggatgttgagacagattcacagatccttaggaaatattaaaacttttgaaaaatggccacaggctctgaaggaaaagagcagttgggcacttaatgccacaagttactcttataaatcattatgctaatgatagaactgaggtggttcatttgggaaaaaaattgaaataacatttaggaaaagctgagaggctggcgatcaccattatgaagacagcagcctgcactattattagatgccaccaataaggggaccatatataactgaaggatgactttaggagtcattgtaaacctgtcttctgacagcagcttgagacaggaattgcattcttcctctaaatccttttaatttagtaaagccctttattgaaacatttacaagcaaatgtaaacttttaaggattcttacatcccataaaagcagtaattttggcatatagctcatcaacatgaaatgagtaaaaacatgggaaggcagtactttttgaatgttgtatgccatttggcaaatctacatgttcctcccttttttcgcatctccatgttcctcctaaatgaaggagttgttgttratgttggtttactttaatatgtccaattataccattatcatctatttatcaaaatagtgccatttaattgccttttgctttaagctgtattttatatgaaagattcctagtgttatttctgtcctttggaatattatccagcagagggaattttaggatctacttgataatacagatttgctaatttccacgttagtacttcagtgttgtttagttacacagtttcgggcctcatgatgtgtttgatgatttgggagtgataaaatgagtcttaagtaaaaatcttttaattaaaacaaacaaaggatcagtttttatgggaaaccagtcagtcagcaagtacatgtgttttaagtccagaaggatgctcaagtggaggggtagagagagagagcccttgggatccagggattgtagagtaactgctcccattatgccaggcctagcagggctgtcccactgtctctgccctcacactgaccacttcattactggttgtttttactgagcatcttttcagagatttctgagaacatggtaattttcccagaccatacacctgagagatcaggtactatgttgcctttaaaaacaacaacaacaacaacaaaaacctttatatttttcctctttttatggtgaaatatggcatactttattatttggagaaagacagaaaacatggtttttttctcccacaggccacaaaataccatcttcctcttacagggaatgagacttttgtataaagaggcacaatttcctgtcccactaggagaaaattattctcttgtctgagtctcaacagaagcttgtgttagttgctgttataaattaaactactactcaacccagcagtcccattactgggtatatatccaaaggaatataactgttctaccataaaaacacacgcatgcttatgttcattgcagcactgttcacaatctaaaagacatgaaatcaacctaaatgcccatcaacagtaaacaggataaagaaaatgtggtacatatataccatggaatactatgcagccataaaaagaacaaatttatgtcctttacaggaacatggatggagctggaggccattatccttagcaaactaatgcaggaacagaaaaccaaatactgcatgttctcacttacaaatgggagctaaatgacgagaatacatggacacatagaggcaaacaagagacactggggcctattgagggtggagggtgggaggagggagaggatcagaaaaaataactgttgggtactaggcttagtacctggatgatgaagtggtctgtacaacaaacccccatggcacaagtttacctatataacaaacctgcacatgtacccatgaacctaaaataaaagtttaaataaataaataaacttggtctccagtgttaaatatgatatgtcatcatcctcatttccttcatccagctattttatattcctcccatctgctctgtcctaatatttatattctgtaggccttatcgtgcatctcttattccttctaaatatgttttaytctgcctggttcctccactcttttggctcttgttttcctacttcctttaatgtaacagtaacacagtgagcacttaatagcagtctagaataaactctgtgttcctgctttaatctatatctggtctttatctctcacctttatctttacctctgtcactgtgtggacttacactgaaaacagaactataccatgcccccatctccatgctgagtagctggtttataaatcaggagagacaatgctctttagatattcttaaatttgttataattctttcctgttatccagctcctcaacctcccttcccagctctgtctaccactttgtatcacttaagccacgttttatctacgtcttctctgtcactaacctttagtcccttgaaacaggcacaaccaaacaggactgacattttgcaagtcccttgagattttgcctaatccttcacagcaacctacaaagtcaatctggggctggtggaaattctcctctttcagccttttccttcttttggaatttgggggtgttttcacagagtgatttaccaagaaaacattctaaatcctcaaggatcacttatcccttacctcgtggttgtttgctcgagaccaagcacaactggacatttttgaacttacgwctttctccctaccctctttgttctccttctcccccttcataaaatctgacttcagtttggccttcaagtgagattgacttttagccccttccatttggcaaatccttcaacaaaaaaacagaagtgtcatttttacggggtgacaaagcattaagaagatcgctttttcagccttgctgtgcttcattataggtaagtcctcatgtggcaccttttacaagaggaagtattgtcatgctaacaaaatggtttcagatagtatgaaatcagtggtgagaagaatggctataaggaatgggctctacaattactgtcactctcagcaaaagagaacgcaaggaatgcatatttcatctcatggcgacctgaggatcgtcctcaattccatatgtaatactttctaaataatggtgacctttttcacgtccccttcctgtatatacaaagtactatgtggataatgcagcctgagtgagcttatgagctaatgcagggatttttattattaacaataatmatagtgaacaacagtttattcatgtaagatcaagcaactagtaagtggtagaaccaggactgggtcatagggtaggtacatgtgtaccacttttaaatattgccaaactactttgcaaagtattgaattattttacattcccaacagcagtgtctgggaattacaataatccttatcatgcaatgactggcgtattcattctttttaatttttgacattctaatctgtgtgtagtgccatctcattgtagtttkaatttgcatttcgctagtgactaatgatattgagcatcttttcatgagcttatttgcatatgtatgtcttctttgctaaagtgtctatgcaaatcttttgcccatttattaggttgtttgttttcttatattgagttataactttttttttttttacatattctgcaaacatttttaaccagatatgtagtttacaagtgtgttttcccagtctgtttcttacctttacattcccttaccagtatcttttgcaggaaagatgttaaatctgttgaagtgtagtttatcaagttttttctttggattgtgcttttggtcttgtagctaagaaaactttgcccaaacaagataacaaggattttctcctatttttttctaggcatgttatggttttaggttttacctttatgtctatgatccattttacattaatttttatatatggtgcaagttatggatcaaagtttagttacatgtggatatccaagcatcctaagcatcttttgcccaaaagataatcttttttatactgagttacctttgctgctttgttaaaaataaattgactatgtgtaagtctatttctggtatctctattctgttctattgatctatatatacttatccttaaaccagtaacacgctgtcatcatgactttagctttataataaatcttgaagtctggtaaattaagtcccccaatgtttttctttttagacattttttttggctactgcaggttctgtgtattttcagaggacttttaaaatcaacctgtcaatttctaataccaaaataaagttctttagaattttgattgggattctcacgaatgtgaagatcaacttggagaaagctaacaacttaatattgagtcttatctctcaacttattttggttctttaaaacttctttcaacaattgtttttcacatagagatcttgtatatattttgtcagagttcgcccaaatggtacatttatttatctatttatttagagatggagttttgttcttgttgcccaggctggaatgcaatagcacaatctcagctcactgcaacctccacctcccaggctgaagcgattctcctgcctcagcctcccaagtagctgggattacaggtgccagccaccacacccggytcattttgtatttttaatagcaatggggtttcactatgttggttaggctagtgttgaactcctgacctcaggtggtccacctccctcggcctcccaaagtactgggattacaggcatgagccactgtgcctggcccaaatagtacatatttttgatgctattattaatgacattgttttattaatttatatttcaagttgtttatttctattacagagctttctctactatgctgacatccatctgaggtctcttctcaacagaattgmctttaatgtccacatttctaccaagcttctcttcaaggaaatctatattttttctattactcaccttaaaattcttgtagcctctatccatttcccaattccgaagccatttctacatctttaggtgtttgttagaggagtaccccactttctcgcatcaaagtctgtatcagtcagtgtttgacagagaacagaaccaataggagatggataaataggtaggtaggcagattagtaggtagatagatagataggtagrtagatacatagatagataatctatagatatctaatgcctggaaagctaatttttctatatattttctctattattttagttgtttcagatagaaggacaaattggatccctgttactctatcttgaccagagtgaaaatctgattaacttttaatcctcagtctcctcatttgtaaaaygaaaataataataaaatctatttcatgaggttattgggatgttagttttgttaatatgtataaaaacttggtgccttgtacataataaatactcaataaatgtatttaaattttgaacaacatatttgacatattgtgattwmcaagtatctatactcttttatgtttgttaatgttatatatggaggcaatctgacttaacatcaaaaaaaaaaaaaagaccattcataagatgtagtcagtaccagtaaatgagagcacattttcctctaattgggtgtgtggatattggttttcaccctacttggagtttctgactatttgtcctagtgaccatcactatattcatttataatattattaaaatcaatggatgagtcattggttaccatgtgtattccggttctgaaacacaccctcctcttccccagccagcactcacctcagtgatacccagtctattgcaggttttttatgcattttctaaattacatgaaagcaagttgacattctttctttgtcttagtcttccataccattattttggcatgtttaaagtatcatccatctgattatgtttggaaataaaagcatgaatttgttaaagacatgtaccttccaaactgcacacttattgtgttttcactttcttatcattgtcccttcattagagaaaaaaatctattctgtgaagtatttggttttttatgcagtctgctctgctctaatatacacaaacacctgattctgcaatgagaattagttggtatgtgattgttgagcagggaaatagtactatttcacagaatttcctttagtttatatatggatttttcttggctgaagaagccagattactggagtaaaattataatctccagcaaaaataaaaaaagaaaagtccacagctcagcccctcctctaaagagttgtacagcgcagccttccacggctcatagcttacagcaggtctcccttccctgccaccaccctcacagcaaccccactggctgagcactctgtttttatttattgtctgagcactcatcagtgcagctctgtttaacatgttacctgtatttccacccaaattttttttttttttttttaagaccaggtctcactctgttacccaggctggagtgcaatggtgcaatcttggctcactgcaacccctgcctcccaggttcgagcgattttcctgcctcagcctcccgagtagctgggattacaagtgcccgccattatgcccatctgatctttgtatttttggtagagacagggttttgccatgttggtcaggctggtcttgaacccctgacctcagatggtccacccacctcagccttccaaagtgctgggattaattacaggtgtgagacactgcacccagcctctaatattttttagaacatccattgtggtagcctcctgccatgctgaacagttggcctgggtggtgcaagttatctcccaattattgggaggtatcaattatcatttttgtttggactttacaaagttttataggttctaagtgatatatcccttctgcagtttttctcataagttctgtttatacagtatgtgattttgcagaatatgagttttttgagattatatatattgcaatatcatagaaacctttttgtttgataatctttgcttaaaataacctcatttattttgtacgaatgtacaaaaataaaacaatgtagtacttattggctgtttttgtggactgaggtagagatgtcaagaagttcaagccaaaaaaactgaaaatagttaacagaaacaggcaaatctcatatatcttgccctgattattttttcattagagtccctcctattgaggaaggttcattagcatgtgatgaaacacattgagggggattaattaggaaatataaaagagtctcaaacttctgatataaggtaaaacacgttaattttatgtgtctttaaaaatgtaattagaaccttctgtttgtcttttctgagacacgtatttaaaatttccctcgactcaactgataatctgtgattttgattttcatcccaaagtgacttttaaaaaagttttggggttagggggatgtggtggctcacgcctgtaatcctaggactttgggaggccaaggcggggcagagggcggcagatcacctgaggtcaggagttcgaggccagcgtggccaatattacaaaaccccttctctactaaaaatacaaaaactagccaggtgtggtggcaagtgcctgtaatcccagctacttgggaggctgaggtaggagaatcacttgaaccccagggcaaaggtattagtcagcagagattgctccactgcactccagcctgtgcaacagagagagactttgtctcaaaagaaaagttttgggtgaaaagtagaaaaaaagtcataactttgtgtagagacttttccctcctgtaattctttttattatcaaatatcaggtattatagggtataagccagtgttcttttttatgatttccagaagtgttaaattttccatgtcttctgcatttgaaagtaataggtttggaaagagaaaagctgttcattcttcaagtacatgtaagtttaagtaccttgcagactttgttttgcaggaagcttccttgccttctccccatatcacctctctgcacctcttcacacccatgagggtctttatagcagtgcagtccataaattgttttgaggtaccaataccagtttcttggatattttcttacttaggaacataaatacttaggctgccattgcgttaataaggaaatgctggatagtcagaatcctacattaacccgagcctaaaatctgtagtatcgcttcaaatatctatgtagaaagcatagtttattaaactaaacatctcctgtaatcccagcactttgggaggccaatgtgggtgaatcacttgaggtcaggagtttgagaccagcctggccaacgtggcaaactmtgtctctaccaaaaatacaaaaattagccaggtgtggtggtgcaaccctatagtctgagctacttgggaggctgatcacttaatttaaaacttaaaagacctaatatccagaatctataaggcacttaaacagattcacaagcaacaaacaaacccattacaaactgggcaaacgacacgaacagacacttttcaagagaagatatacacatggccaataagcatatggaaaattacccaatatcactgatcatcagagagatgcaaatcaaatccacaatgagataccatttcacgccagtcagaatggttattattaaaaggtcaaaaaataacagatgctgacagagtaaagggaacgctcatacactgctggtgggactgtaaatcagttcagccgttctggaaagcagcatggcgattcctcaaagaacttaaaatagaattatcatccaatccagcaatcccattactgggtatgtacacaaaggaatacaaattgttctatcatgaagacacctgtacacatatgttcatcatagatagcactgtccgcaatagcaaagatatggaatcagcctaaatgcccatcaacagtagattgaataaagaaaatgtggtacatatacaccatggaatactatgcagccataaaaatgaatgggatcatgtcctttgcaggaacatggatggagctggaggccattatcctaagcggactaacacaggaacagaagagtaaatactgcatattctcactcataagtgggaactaaacaatgagaacctatggatacatggaggggaacgacagacactggggcctacttgagggtggagggtgggaggagggagaagatcagaaaatatacctatagggtactatgcttattacctgggcgatgaaataacctgtacaccaaagccccatgacacgcagcttaccaatataacaaaccagcacatgtacccctgaacctaaaatacaagttaaaaaataaatacataaaaatttaaaaataaaaaataaaactgcaaacgtgccctgctttctggcagtaccccattccctgttccttagttttctctctggcacttatcatttatctattttattcattgtctgtctcccttcactagaggttcatgagggcaaggattttcatgttctgtccactgctatgtccctaacacttaaaaaaaggctttgcattctatagtcattcgatgaaataggctgaatttagctaaaagggagttcatgtcctttgaagaaacatggatggagctggaggccattatccttagcaaatgaacacaggaacagaaaacaaaataccacatgccctcacttatcagtgggagctaaacaaagaaaacacatggacacaaagagaagaacaacagacactggggtctrctgagggcagaaggtgggaggagggagaagatcagaaaaactacctatcaggtactatgcttcatacctgggttacaaaataatctgtacgtcaaatgcctgtgacacaagggtacctgtataacaaacctgcatatgtacccctgaacctaaaataaaagttgtttgtttggtttttttgtttgtttgtttgttttgagacagagtcttgttcttgttgcccaggctggagtgcagtggcgcgatcttggttcactgcaacctctgcctycttggttcaagcaattctccctgcctcagtcacccgagtacctgggacaacaggcgcctaccacaacgccaggctaatttttgtattttttagtacagatggggttttgccatgttggccaggcttgtctcraactcctaacctgaggtgatctgcccacctcggcctcccgaagtgctgggattacagttgtgagccaccacgcctggcctaaaagtttttttaaaaagagaaaacactttccttaccctttgtagctcattgtctatctaacacaccctgtcactctcatcagccttgaacttcttacaaagccattcaataaaatgaaaggaaataggtgcagtgggccccctctgattcgtggctttgatttctttggtttcatttatccacagtctaaaaatattaaatggaaaatttaaaaaaaaaacaattcataagtgttaaattgcatgccatkctgagtagcgtgatgaaatcttgccctgtyccactctgtcccatgcgggacatgaattcttcccctttgtccagcagttcctcactgtctatgcctccgacctgttagtcactcagtagccctctcagttattagatcgaccatggcagtatgggggtgcttgtgttgaagtcacccttattttacttcctaatggcctcaaagcacaggagtagcaatgctggagatttggagctgccaaagagaagccctaaagtgcttcctttgagtgaaaactcttaataaggaaagaaaaacattgaatgctgaagttgttagatcttctatctgttgaactgtgaagaagaaaaaagatatttgtgcatagtatataaagggtttcgtactacccacggtttcaggcatccactgggtgtcatggaatgtatcccctgaggataaggggggattactctatgtattttcgtatccttacatcacttacattatttttcctcagccttgttgaggaaaataaaaacacagaagccaagaaagaaatgagcaagcactggccgggcacagtggctcacacctgtaatcccagcactttgggaggccaagacgggtggatcacccaaggtcaggagttcaagaccagcctgggcaagatggtgaaacgccgtctctactaaaaatataaaaattagccaggcacagtggcaggtgcctgtaatcgcagctacttgggaagctgaggcagagaattgcttgaacctggaaggcagaaaagttgcagtgagccgagatcatgccactgcactccagcctgggcgacagagcgacactctgtctyaaaaaaaaaaaaaaaaaaaagaaagaaaaaagaaatgagcaagcactgaacacctactgtgtgcaaggcacttgatagccttcctgttatttcttcctcactacaatcccatgaagtagttcttatccccattttacaagatacaaaaattgactctcaaaaagcttaagaaatttgcttctagttgcacagtcttatagattttcacttttataagataaaagagcttattcaaatccaagtctgtttgaacctgacaaggaaagccttctctaaatagagtatctgaatccctccctgctcgaaagtctcctttatacgctcatgtttcaaaaatttcacattttttgagatatagatagtacccacccacatcacctctgtttttatggaaaatttacacttaagtggcaattattttaatcagatcgacatcctagagagtgagagttcattgaggaaagaaggaaggtacatttttggatcataatgaggagagatcttgatatttttgaaatttgttttgtcttcccatggtacaaagttttaaaagtacaaaaatatgaacagtaaattctcccttctctcccatccctgtctctagccacccactcctcttctgaggcaagagcagattctgttgccaccttcccaagcaggtagtgcctttaaaaaacaaaaaacaaatgttcacctactatatgcattaccatgcaccttacacttttcatttaataaatataccccagcaatggtgatagcagattttggaccagcagtggggataaagaaggtcctggtcacctaggtgcctaaagagaagcagrtgaagagagaagaccctggagaaatgttttcctgttttgcacctgcaggtgcttgacatgcctctgaaaatgatctcagtgctgtgcagttccacagctgcagtggtacccacaatgccaaaacttgggatgcaaaggggcgggggtaatgacaaaaatcagggaaggaggaaccatagcaaccacctgatctgcacactcatgtattttatatacctctcttcaatgcctagtgtccttagacagtaagctccctgaagacacaggctatgcctactttattcatcatcgtgtcttcagtgcctagcaccctgcttggtatgcattcggttcatgaatatatgagggaacctgctgctgctgttcagcattcacacctccatttcaaccccatcagaaccttyttcatgcttcctcttttgtagtgtctcagaaactcattctgttttcttcttcatctttttttttttttttttttaatggagtcttgctctgtggcctaggctggggtgcagtggcatgatctcagctcagtgcaacctccacctcctgagttcaagcaattctcctgcctcagcctccctagtaactggggctacaggcttgcaccaccacacccagctaatttttatacttttagtagagacagggtttcaccatggtggccaggcttgtcttgaactcctaatgtcaagtgatccacctgccttggccttccaaagtgctgggattacagatgtgagccactgtgcccagccttcatcttcatcttaaaacttcttccatgttcgctgtggctggggacatgatattcctctttccctcccagttgctcctaaggatgagcaaaaagctcttttcacgtcaggggttgtaccgccaatcactaaaaggaacagttgaaatatcaaacatggagaaattgcagtgattacaaaggaatgcaatggggcaccatacagatctgaatttgccagtttgccatatccaggctgtccctgttgcctctggtccaccttaagctaggtgcaaacccagttggaggaaagaaaggaagttatgtgttctctcttcaaggaagaaaccagataccagcctcaaactcttgttcttaggtcacttctttccttggtccatttcactcctcactctccattcaattaaaggacttgcagattaggttatttgcaagtatttctgtaatttattctcctactcccatttgaagccaccaagcctgtttaatattaaataagcaaatgcttcaagtactatggtgacttcttctgtgcctttgcaactaaagccttccaacagcagaggggagaaatttatatctgttatatacatagatgagtaatttgggaatataaaacaaatatccttcttagaaatatttaaacacagatgcttgattttgtctgatctttctctctcttttttttctctccaaacaactggttacccacacttgtacagtcatgtagagacaaaatgctcatttataattccagataccccatgtaattattgcctatgataatcaggtaatctttatgaaactattcctatacaattttcaaatctcagtttacaatcatgagtattttaccataatcttcataatgccctcttgawtatatttgcttaatatcattttgaatttagtgatatttaagttaacatattttatatgttttcatttcattagtaggcttttaaaaatttacttttttgtgagaatctgatttttgtgagactctgtgaacaaatatcctcactaattctttctaatggtataatgtgaatttgtcattgacaagtgttacaaaaaagacgcatagaaaataaaatattttaggtaatcctaagatagctcttccgcagccagggcaattgggctatgtgtctttgggttgattgttagctctgtcctaaatctctgaatttggagaaggaaaccctggatttgaattccagttcctcaacttactggctccatgttcattccttctttgtcaagccccctaacttccctaaacttcagtgccctcatcttaaatataatgacataatagtgtctctcataagattggtagaattacatgggataattcatcttgcatggtcaggggcacggtctcgggaaccagactgtgtgggtttgagctgctcagtcttggacaaaagattaaatatatctrtgcctttgttttatcatctataaaatgggaataaccatagtaccttattcaaaggttgttgtgaagattaaaataaattaatcctgtaaaaatgcttaggtttctggcacatagtaagggcttagtaaaaactaggtatttttacctggtatgtgcaagcactgtatrtatcctgatatactttctcatctataattctgtttctgtgcactagtttatatatttatttaatggaattattttctacagatttagtcagattttagaacacaaagcaagtggatacttagtagccataggggaatctgattttgatgtctcctacccaaagtttattcatatttaatattatatatacataagtcttattctttctcttcgtcctttttttttaaaggcaagatctgccttcatcttcggttttctttagtgcttagaagattgccttgctagtgataagtatttttgcttaataagtatatcttgactgtgaaatttgtcaccagttttgaaaggaactctggcagcaaatgaacaaacttaaatccttgtggccagggatcaaaggcaatctcaaaccgaattctataataaagagaagtttggagagagaaagggagtttagtgtaaactcaacttttgaaatccaaaggtatcaggctatcatgggaagagtgtgggattcagctttagccctggggtcacaaagtcatgggtatgctcttatataagtaacttaatcagatctctgtttcctcatctgtaatattaattcccttctcctatttcatagaaatgcttaaaatttttaacagaggtaatatatgggaaaatgctttgtaagctataaaattagtgtacaaatattagggtcactgatactctgtgacgcaattcaatgatttggtagaagactatatatatatgtgtgtgtgtatatatattttatatatatatatatatatatatatatggccaaccatatatctattagtagctctctctatatatgttttaaagccaggctggtcttaatcttgtctattgaattcattttgacaagaacagtgtaggatccattagtcctttacaatgaagaacatattaggtgagtcaatacttaattccaaaattttactttagaataagagggatgtctaacatcaattgattgaaggctggaggaaagagcgtggagagaaagaagtaacacactgctctgtgtttttgtgcctctgtctccagaataaaagtggacatgcccttcctcctccttacctctctctctctgtatccctttcagtacatatgtccaacactgccatacacagcctcgctgaaagtatcaggcaaagggagaaacagtgagcattcctacctccagccttgacaacaactatgaagtgtgttgctctaagctctgatcataagggaattagaagcactatgattttttaaaatcaaaatatgcctgtagctccaaaaaagaagaatttgactatagggtctcagctcactgctaggagaggtgtaactgattaaactctggtgcagaatgtatcaggatggaaggaatctgagaagtcaccaagttcaaatccttactttcagtccacagagtcatcctgctgcatttcctttttatgcctgcaaacaaaatgtttctggaactcatttattgtcagtgagtgctccctgggctctgaagcccagagatgttcctccataactcatcagaggcttgggtcatttctgagacaataagttactgctaggtcactgaacatacttggggtaggcagtggggaaggggattctgtgataagaaggtgatcatgtgttctctatttataggaaaatgaatcattctcagggtgatgagcatgtgtcattaaactgttttcctgatcatgaccttgcaccaagctgtttgccctctttgccctgttccctcaggctcagtggtcagggagggtgggccagctggccgagatgtgcagtccagtccagagttcaagaacagtttgaactgtgagactgagagccaagctgactaggtcagagtgagaagccattcctcagcatatgggagctgttagttagtgccctgaagctctctagttatttggggaaggaatgggagaaagcacttagatccctgctgggctcattacctttaattagcttgcttggtctggtggctactgcagagggggaaatctccaaaaactgcaaaaagattgtgcatgatggtgggggaagatactttaagaagggaagaagactctgttgagcttccacaaagaacaggttgttcatacctgaatgcacacagggaatgcacaaattttataaacaagaaggctgggtttgttttttttaagtttttctgtttttaaatttctgtttatttagcgggtacaagtgcagttttgttacatggatataactctggtctttcagtgtaaccatcactcaaatagtgtaccttgtacctattacgtaacttgtcattcctcaccctcctcccaccctcccatctttytgagtctccaatgtctattattccaccctctatgtccatgtgtactcattatttagttcttacttataagtaagaacatgcaatatttgactttctgtttctgagttatttcacttaagataatagccttcaggtccatccatgttgctgcaaaagacatgaattgattcttttgtatggctgagtagtattccatggtgtatatacgttacattttcttgattcaatcatccattgattgaatggtgtcctttgacttatcaaataaatggtgctaggaaaattggctagccatatgcagaacaatgaaactcgttcccctatctctcaccatatgcaaaaattcactcaagatgaattaaagatttaaatgtaatacctgacactataaaaatcctacaagaaaatttagaaaaaactcttctgggcattgcctagggaaggaattcattactaagaccccaaaagcaagcaaatgcaacaaaagcaaaaataggcaaatgggacttcattaaactaaaaggctttggcacagcaaaagatataatcaacaaagttaacactcaacatacaggatgggtgaaaatacttgcaaagtacacatccaatgaagggctgatatctagatatctagaacctatgaagctgtttttaagaacagaatgaggacatgagccaacacccaggattccagtggaaagtgaacagagcaggcacagttaatggaaaatgaacagagcaggtacagttaatggaaagtgaacagagcaggtacagttaacgtcatactttacctttttccatttgcacttcacgaagagatgagctttgatagttaacttctctctctttttctctctgttttcttcttgtgcaaactgggtgatgacattgactctcttcacaggaaagcactaagtgaggattaactaggtaatgagagcaaattggaagggtgatggagatgctccgcaaccttgctgatggatttctcccagcgagagaatctcttcaatgcatctttcatctgtgtcttacaggcagggtgtaccatcgttatctctgcattctgcttaagccatcccctccaaaccctgcctctaaggagctttggcctattccttgaaaggattcttcagttatcccaccaacaatcagaggcagcaggactcaatatccccctgtatggagaaaaactgagacaggagattgggctaagttgtcagtgattcacccccattcctgccctaaggaaaggatctttttctttccttttttttttttttttttttttgagacatggtctccttctgtcacctagactggagtgcagtggcatcatcatatctcactgcagcctctacctcccaggctcaggcagtcctcccaccttggcctcctgagtagctgggactacaggtacatgccaccatgcccagctaatttttgcattttttgtagagacagggtctcagcatgttccccaggctgggctcaagcgatctaccctgctcagcctcccaaagtgatgggattacaggtgtgagtcaccatggcaggccaaaagcatcttctcaaaaatctttcttccaaaatgtatattatacaaactttctggagaacaatttaggaaaataagtattcaaaattcttagaaaggtgcatgattcttgcccactgaattccactttcagcacatgaccattagtctttcatttcttcttctcttcttcacaccagagtgtattgccttcaacaaagaaactaaccacttttagacttgtaattaacctgtcccttcccctcatctgcccacctgactactgaaagtccccagagtctgcttcttagtgggacaccagccttctgcaaggcacttattctctggttatgaacctgtttaaggaaatctatatatttgcacagaaccatggaaatatagatgtgaacaggcttaagtgatcacaacccacattttttttttttttttgagatggagccttgctctgttgccaggctggagtgcagtggcgcaatctcggttcactgcaacctccacctcctgggttcaagcgattctcctgcctcagcctcccaagcagctaggactacaggcacgcaccaccatgcccagctaatttttgtgtttgtagtagagacagggtttcaccaagttgaccaggatggtctcgatctggtgacctcttgatctgcccacctcagccccccaaagtgctgagattactggcatgagccaccacgcccagccagcccacactttttatcagatgaggaactagagactctgagaagacaggtggcttatccaagagttcatacttattcaaggctacagaataaaccagaatctggggcctgtaactcccatatgggcccttctcgagttatggagacttaacggtgtgggacacaaaataggaagaagtagagtaaaactttataaagtaggaaaagaaataatgtttgtactatgtataatggcacttcaaaatccaccattaggagtgtctacagtttcctctgcataatttagaggctgaggccatgtacctcaattcagtccagttttctatccaagaggtgcaagctctaaaataaaggaaaggaatattctttatcagtcatcagcttaatctcaaaatattgtgtgctccataattgaccttcattagggcattatggacaggggcttactatatgctaagctatgtaaatacagatgctcctcagcttataatggggttgtctggataaatccattgtaagttgatccacacataaccctattaaaagtcaaagagcatactgaatgtgtwttgcatttgcaccattctaaaatcaatgtgtcccwtgtgtaaaatcagttgcatccgaaaagcctgaaacgtgtacatattctttgatctagccatcttattctaaaaatcaaaataaaatcaaaataaaatcaaaatataggtaagttgaactgtcataagttggggaccatgcgtactctgatagtcagtgttatgtatgaacttgaccaagccgcagggtcccagacatttgtccagccattaatcaggtgtgtctgtgggaatgtttctggatgagatgaacatttgaactggtagattgagaaaagcagattcgtctcccctatgtcagtggacctcatccaatcaagaccggaatagaacaaaaaggctgagtaagagggaactactcctgtctgactgctttgagctgggacatcaatcttctggccttcaagctcaaatgcaaatatcagctcttcttgagtcttgaggctactggttttcagactagaatttataccattggctctcctggttctcaggccttcagatttagactgaaactacactatcagcattcctgagtctccaaattgctgactgcagatcttatgactttccagtcattccattccttgtcataactctctttctctttctttctctctctctcctctctctctctctctctctctctacatatatatatatatatatatatatayatacatatatatatatatatatatatgaacagatacatcctattggttctgtttctctggagaaccctgactaatatacagttatgtgtcacttaacaataggatataytccaaaaatgtgtcattaggcaatttcatgatttgtgaatatcatagaatattcttacacaaacctggatggtttgctgcacacctaacctgatgcacactgaggctttatgggatagcttgttgctcccagactagaaacctgtacagcatattactgtactgaatactggaggcaatttctaacacaatgacaagtatttgtgtctctaaacatagaaaaacacagtaaaaatatggtattataatcttatgggaccagttgtatatgtggtgtgtcagtaaccaaaatgtcattatgcagcatatgactgtatatatacatttacacttaatcctcacaaaaaccctctgaaataggtactattgttttgattatcaacctaactttaaaactgggaaattatacatagactggttaagttcctcgcccaaagctacacactgcatctggaaggagtctgaattcacccagataccgcgtgctccatctgtttgattcacattctcctaattgtgtcccaaaagcctgaaacatgtgcatattctttgatctagccatcttatcctaagaatttaccctaagtaataatcatggatgtattcaaatatatcgcaaaacatttataacagtaaaaatatctaaacaacttaaatgctaaacaataataggcgattggttaaatgttctatgatgtagttactcagtgaaatactaccttcattacaaaccatgccctcaaggactatttatttacttgggtaatcattcaagctatatagatgagagtaaaaggcctgttacaagcctgaggagagatggtaactaaatatactgtatgctcgatgagaccctgaaattacattttaccatgtttccttaggcttgtagcattccatttttacttctattctgaagcagaaaaaggagattagataaaaactaagaaaaccttaataaaggccgggcgcagtggctcacgcctgtaatctcagcgctgggattacacacatccctgtttttaaaagtgaaatctgccttctatagaacacattcccccacagaaatatactacagaaaacagacctaataaagtggagttttgttcaaatgcttccctcacaatgatgctttaatttgctgaggaacatatgattgatcctagttcacctgctgaacatgcataggcagtgtgcatctctagcacactgattaaaatgaatacccagaggctcaacatgatttcttattaatcagaacatacacaactttgtgaaagggaccttagagccattctctgccccagggtgaactgggacacaggtatagaaacctccaggactctgttggaagagtttttcttctaggttttttttttttttctgttataactgtcctttccaagattaaatgatgcctaggatatcacatcgttcagaagaggttgaaagagggagttatttataaatcctgaaggttctaggaggtttgggcttagaccactttggactcagagaaggctgtgaggtaaggcatgttctaatcttgttgatggaagtcctaatgtgtcttagaagatttctggtcatcactgtctttagggactcagagtcttcctctaagttagtttcaggaccctttgaagtattggcattgctggctcagtccactggctctttggccttcacctgtctgcattatggttatagctgagatgccaggaaaaacacaagatgagtctgttcagctcgaagctgactcaactggtttctaccacctcaattcaaactaggaatgagatatttttcttcctttgctttttagggcaattaatgttcccacatatctccctttttcttgccatttcttarcatcctaaacactaattttgcaaaataatgttgtaaatgctttgcatagtcactatcttatgttgcccttcctgttcacaagacagccgtccgtgtcagttgaagatttctatagatatgcatcatctctgatagataaaggcatgtttcagagactatcctggtgggagtattttacttttgaaaccaactaaatctggttttgctcctgtttgtggtactttatttctccctgtagcaggagagtagtgccaacgtgcctggaaaatcaagtttcaaacctctattgcattttaagccatgttttagaatcttagggtcaattaatattagagttcgacaaaatctctgctctcaaacaaaattatatacaaaagctcagtaagtaaaccaggtaaatgttaaggtgcttcggttgaatctaggtttaggagtccagagaatctaactcaaacctggcagctggaggatacccaagaaactccctgggcttagtagtgtacagtgcgaaaaacagcgatctcatccatgtccttcattttagggagatgatacctaaactttgtgggttttatttcaaagtcacatgttaattagtggcattgtgagggaagcatttgaacaaaactccactttattagatctattttctgtagtgtatttctgtgggggaatgtgttctatagaaggcaggtttcacttttaaaaacagggatgtgtataatcccagcactttgggaggccgaggcaggtggatcacctgaggtcaggagttcaagaacagcctggccaacatgatgaaaccccgtctctattaaaaatacaaaaattagccaggtgtggtggcacgtgcctgtagtcccagctacttgggaggctgaggcaggagaattgcttgaacccggaggtggaggtttcagagcaagactctgtctcaaaaaaaaaaaaaaagaaagaaagaaaaagaaaaaggatgtgaaaggaaagagtttgcaaaaaaaaaaaatgcggcaatcacaatacatttatgtctattcatattatttgaatttgtcattttcttcagtgattttttttccttgggttgttcttatttctacatcattatgtttattatatgaaggaagcagtcagcctcatgtttattctctggtagagaagaggaaaacagtaatttttgagcatgaatgcataagaccatacagtttatggaaatggctgtagcttctctaacctttcccctttcatacayacttgtttccatgtacacttcattccccctttttccccctttaactctctttgtatttgtatccctccttccctatgccctttttactcaattcattccctacatcacaacctgtggtttttgtatctgatcatagttttcaccctattgaaaatcatggctggccaagtacatgttaacaggaaaattctggacagtccctttgtacacaaaccttactgcttagtttcatctgtgcagattgctgtatactcagccctgcagcagagagaccacactgcagcctttagtaggaaaaggataggaatgacaatacactgcagacacttycgtgagtaagttgctaaagcgtcagtaaaacatcatggtgaggcctctgcaatcagcctgcttagrtttaaatgacaattctgtcacttacaaatatataaccatttggatagttatgtttgcactttaagcctcatgttagttatctggaatagtatataatattacctacctttagtgtcatcataagaattaaatgatttttgtgatataaagtgttaagtgtggtgccagaccctggcaaagttggtaattgtccccttccttccttccccgctttcaccttccttcctccctccctccctcccttccttccttaattccttctgtccttccctcccttcctcctttcacctccttcccttccttccttctttccttctgtctctttcacatgccttctttctctcttcccttccttccttcccctcaccattctatgagggcataactgggagggttaatagaatggatatctaaagcagcgattctcgaatataggcttttaaccagcagaatcagcattacttgacccgaaaacttgttagaaatgcaaacacttaagtctcacccctaagctcctgattcagaaaatctagggttagggtttaactgtctgtgttttccttgtttttgtttgtttgtttgttttgycgttgttgtttgttttttgtkgttgttttgttttgtttttgagacagggtctggctgtgttgcccaggctagagttcagtggcacaatctcagctcactgcagcctcaacctcctgggctcaagcgatcctcctacaacagcctctgaagtcgttgggaccacaggtgcaccaccacgcttggctaatttttgtatttttggtagagacagggtttttccatgttgcccaggctggtcttgaactcctgagctcaagcaatcctcccaccttggcctcccaaagtgctgagatacaggcatgaagtcactgtgcttggcgttttaaccagcctgccagatgattctgaatttgaatatyctggtgagaggttttaaatcatgcaagtggctgtctgcctccagttaaggtaaaaagggaaaggcctcagcttacactgtggttgagccatatgacaggacatacaaacactattaatattactagagaagcaaccagcaccgttttgaatagctcagtctattgggggtgtgccttctactcaagatgtaaataaggataggaaaaatagcactagtatcaactgccatacaattatttagtcacccttgggtaactaaacagcataggtatgttgatcaaaatgcccttgagtaattgtcagtggaattttgaactctccccaattcaataagatactgctgcaggtattggtgaggtacagggagcatctaaatggactgtctttcattgtcttccttgaaggttctaaatctttgtttttctggagaatattataggatagaatgtatatcagaagtgagacttgggagacctgtgtgacctcccaagcatgacaatattcacagatattcagatccatagaacacttcangaaattgtctttatgttcaaagatctcatagaacatttagttggatacccttcccacacacatctctccatttgataaagagacactatcttttcaaactttctttttggtctttacaagaagaaccctgttaggatattctcaagatttgttctagtcacacgggggtgaaggggaagggggggtgtgttatagaagtagctctagatcatttagcttaagagttaaattttttgcaaaaatactttgtggtggatttctgatgccagtccgcataggacttttattatcgtaatagtgttttgtctttcttttttaagattaggaaagtatattcaccataatatttgttgttaatcacttattttttatgcacccttttccaaagcaactatattgtccttatcttgaaaaatgaaaataatagcttccagataaatccttatgatagttttgctatcactagatagtggcagagggaaacagaggaaaaggagatctatgcattgtctttgaaagtcaagattattatactaaatgtttttgaagcattttgaaaatacagcgatatttacttataattctcaactatattacagttactggatctaaatgagaagtttgttcatctgtaaagtatttgaatgctaatggtattcttctagtctagtgcattcaattaaaatataacgtgtgttacatatgaagttaaaaatgtttagtaaccaaattaaaaaggtaaagagaaataagtgaagttaattttaataatatattatctttaacctcttttaataatatactctctttaactctttaatatatttaataatatattctcttttatatacatagaacattgtcatttcaacatgtaatcaatataaaaaatatcaattagatattttacattctttttttcacattaagtctttgaaatttagcacgtattttacacttacagtacatcttaatttggactagatgcatttcaggttcccaatagccatatgtgtctattggcgttcgtatcatatttatcatggcagttttaaatgtattaaaatgataagtctataaggtatcttcttaagtaaattctcccaagtataacagatatcagaggtaatatacacctacaaataattattgctaaagtaaaatttgtaaagctattgactgtcagtaaatatgtttaagaaacagtttttcgtattactctaagattgttcttaaaaccagcattgcagttcagtagacaagtgcagatatttgaaataagatgtttttatactacctatgtttaaatttcatgagcttcatccagcactggattttctggattctgagatatgctattcacatttcaacatttatgaaaacagaatacatcttacaattaatgtgttcatttaatgtaatcatacttcttgttttcctgaaactgagttggaaatcatcatggaaaataggttcttctcaacacaggaagagttctcagctattgtatagttgtgtttttgagaacatgcttcagcacttgagagatggatttcctagagtttttcttaaggatcaaaattaaaaggtggaaatatacaaacgctaaataatggaattaagcattggccttggataacagaaggtgaaggagataagagacaactttctgttccagctccactttaaccacaggggacataaatatatgggaccttgtagtatttaaccttgttaatatctccatactgttttgcagtaggygttggaacagagcttcacatttttctggtggaggagccagtgatctctggatggtgaaaatattctctaaaacagactccacaactacaatgaccagtacaatgtgttttctatgccgctgtcctctgtcaaggggcatcacaagtggctggcctatattcatgtaaaggtagaactagamcccaatcaatgtgccctataaatacccaagtctttaaatacccttagataataaaggtaaaagatgcaagaaaaagaggactgggagagtggrccaagtttatagttctttcaaagtctatttgaattatttaaaaccattctttttttgttaatagattttaattctcatacatgtcacatgtttcttttgcagaattcaaaacatttttaaaaacacccatttcaataatattgcatgcaaggtaaacaagaggttagaataactagtacaacataacgcagcttgactagaatacctcgtcataacacaagtacatcttcttttacatttatgcaaagtgaaacattgtctgtctctctccatagtccagaaaaatctgtggggtaattgctcattgtcccttcacaccctgtttatattgcgcgtcttctattttaatagtcccaataaacagatggaaccacaaaaacacagccgggatggctcagttggtcaatggcatcagagaacttaaagtgcctgatgctgatgactcttccagaaggcaatcctcttatgagggtcagggtctagagagtccacgttgctgctcgtactctctgtgtttaattccagctaacatgacaaagtgcaagcgtatgacaaggactttcagtgtgaccatcagctggaagaagccaagtgcgtacagctcccggtggggtggcacatgctcctcttgtgacttaatggtggcttgtggctccacttcccttgggggttgtttttgttgttcttctctcaggaccacatttattttgatgttttaaaagagaaagaaaagttccaaaaacttcctttctcgtatttcctctttgagatccagcaaaatttctacaactggccttttccagatggcttgcccagaattgctgagagwttgaggcacctcaagctctgggctcaacatcgaaggttctttaaatgtgccttttatcctttagtttctgtcacttgatgatgggtgaccaccctcatctctctctctctctctctcttttttttttttcctactaaacatgagattactggaaatatttcatgattggatacatgctattggttaatccatttaaccaaactcccatcaatggatgtggagtgtttacaacatttttgctcttataacagtgcttgacaatgtagggatttgtcaggttttaatccaaatagggctttatgatacttgccattatactatcagatactttttcccactgatatggtttggctgtatgtctccacccaaatctcaccttgagttgtagtcctcataatccccatgtgtcaagggcgggaccaggttgaggtaattgaatcatgggagcagttttccctcatgctgttcctatgatagtgagtgagttctcaggagatctgatggttttataaggggcttcccccttcacttggcactcactctgtcctgccccttgtgaagagggtgcctgcttctcctttgccttctgccatgattgcaagtttcctaaggcctccccagcagtgtgaaactgtgagtcaattaaacctcttttctttataaattacccagtctcaggtatttcttcatagcagtgtgagaacagactartacactcatcttttgaatacattatgtgaagtacaacaattttttccaaaccaaaccagacctggctaaatcctttactatagaccccaagattgagagagagggaaaaaggaattgatctgaatcaaatttgctgttatcaagaagtagggtagggaagggaccaatatgagatgtacgaaaattggctcccaaagtacagaaaaataaagatttgacttgcctactcctggcataccatttgtaggttctggccaacatctgcccttctctgagcctggagcttctctctttcaaatgggagataattgctgggcagctagagctcacaggcacgccgcatgatgagtgaggtcatgttaataaagccctgggaaagaaaagcaatgtgaaacagcagggctattaccgttccaagacgattttatacaagtgaagcttaagttcagtgtgatgattaacaagctattagagccaagttattgattcctctatctttagagtagctaatgcagtgtgcaccaataggccacagaccccaagctttccttcttcctgtgctcctgttctttgtaatgatgctttccttaggaaaatgaaaatcacttcgcatacacagtgcaacatctttaaggcaggtgccagcagagaggaaaaacacctaagctgattttgtgtgtttttattattttttctgataataaagattaatgcagatacatgaaaaaaacaaaacataaaaagtaggaacagaaagtcaaatactgcatcttctcacttataaataggagctaaataatgtgtacagacaggcataacagaacggaacaatagacactggagacttggaagggtgggtgagtgagcagggttgagggatgaaaaattaccttagaggtacagtgtacattatgtggatgatgatttcactaaaaccccagacctcatcactatgcaatatatccacataacagaactgcacttatacccataaacttatatttaagaaaagaaatagaaaaaagataatttttttaaagtagaaagagggaaaaaagtaaagcatcatcccaatttctttcaccctgaagcagctagttttgctaatatgatcatatacctatccacacatatgtatatgatcatattaaacatattagtttataacttgttctttgttccttttctaacatactcctcacaaaataatatcattgatagtttcccatttcaattaaaacagatatcaatataatttatcagcaaaatattttatggatgtgtgtacagttttggttaatccatttaaccaaaatcctcttgatgaacacagagtatttacaacatttttgctctcataacaatgctctgatgaacctcatgcattcatctttgagcttttgaccaattttccttctgtggtaaattcctgaaagtagaattgttgggacaaaagatttagagattttgtatctttaaacatattaccagtttgccaacccaaagggtcatatgagattactttctgcctacagtgtagtaragtgccagcttctcccaacaaccttgccaacgttgggtattgtcaattttttggctctttgccaagctgataggagaatggaatgtctaatggtttttgaattacattctgactgtgctgcatcagactgtaactgaatgcagttgtgatgtatcaggggacctggtttaactcagcacactgtttgaatctgtgtaataactaactatgatataatcaggctttcttgcagttttgaaaaagaagccaaactttcacatggtttaaattactctctcatttacactctccatgtgtgagatcacctgggaagccctttggagatgcccccagtgacccagtacaagttgtcaactgcactccccatgaaagagagattgttctggtccaaaccctatgctctagaggagcatcttggaaacagcactgccctataattgatattgctccattgggtggcctgtggtattcaattcactggaaagtatcaatccctttgccttcagcaataatattttcacagttttgatgtgttttaaaggttattgtctccaggacaggtaattgaggaggcctcacacttcatcagaggccatttcatctttattacacagccacacacaaggcagcattttctcctttcactgatggattatttcaagatttataaggtctggtctacatgaaagcaaacacatgtttgggtacacagtcaaataattcaaagatatagggtcagcaggatcctaatattaaagtcaggacttccagcctgggcaacaaagtgaaatcttgtctctacaaaaaatacaaaaaattagccgggcatggtggctctcgccagtggtcccagctacccgagaagctaaggtgggaggattgcttgagccccaggaagtggaggctgcagtgagccatgttcatgccagtgcactccagtctgggccacaaagcaagaccttgtctcaaaaaatgataataataaataataaaagtcacaactttttcctcttctacctgtgccagagacccactacctaacccacatacacacagacacacacaaacacaccatacacttattcctttcttaaaatgtggctttcaaatatttgctttgcatgcagttttctctgaagatatgaccagtttcaagattatctactctaagttttctgactggttgtcagtcagtcagtttggaaccctgccataacatattttcctcaaattccttgcagatactggaataataatgaatgggaatgttattttgagccgatatttggaaagtccttatttggaattctacaagtttatgtctcctgcccagttcctaagccctctttctagataaccatccagaagataatcatccagcagctatccgggtacattcggctgacttggttagttgggtctaagcagtatatccatgagttctaactcgggtttctcaaactctttttcctttgggtttctcagactcttctctcaaactcaaactgccttctccagtccattgctaaagcttgtatgacctttgctttccctccatttcttgacttgtggcatccactagtcctacattgtaggactagtgtgagcaggtcactcagcctgaaagcactcaccctgggcctctagagctaagttgcctcaacacacttcactatggcttctcagagcacactcaccttgaatgtttagaaaaggtaatctttttggggttcaatgagatcaaaagcacggataccaattttgggatcaggaatcaggaaaatctgggaaatgaagaacgaaatgaggccttaccattttgatacaaagttcatattcaagtgagtcaggagatctggtttaagttccagatctgcctcttactagttttagaatcttgggcaattctaggctggacgtggtggctcacacccataatcccagcaatttgggaggccaaggcaggtgaatgcttgagcccagaagttcaagacatgccttggcaacataggaaggccccatttctacaaaaataaaaattagccaggcatggtggtgcattcctgtaatcccagcaatatggaaggtgggaagatcacttgagtccaagaggtcaaggctgcggtgagctatgatctgccactgcactccagcctgggtgagagtgagatcctctgttaaaacaaaacagaacaaaacaaacaacaaacaaacaaacaaaaaaacaaaaaaaattggagggaatttagttcatatatttgagtctttgtttcctcatctagaagatgtagtaaagataaatgaggtcatatatgattgtccctggcataatattttggtacttattgaaaagcagctattgttttaagtcctttgcatatacatttctatgatttactatatatcagtagcatttctccaacccatcttggctaggcaagcaccactgaatatgaaggaggccaaatagaatgatactatccaagctgcaaagaaacaaacaaaagaaaacatctaaatgcatgcctctttggartggcatttgcatccgttgccaatatccatagaacaaatgccttcaggcaggaagaagttgggataatgtcaatgtttttaatagctgtagtagagtcctatttagaaagcagtaattatctctccatattgattttttacatcccctcaataaatccagaagaaatgtgaagaccatctgtaagtgtgatttttaccaggatcagactctaatttgcaatggctatgtgtctgtttgatttagatcaggggttagcaaactgcagcccacaagccaaaactacctcccccatctatttttataaataaagttttattggaacacacccatcacacccatttctttatatctgtggctgctttcatgctaccatggttgttttatttaattgtaacagagatctaagagatctagagcccatattgcccacagagctgaaaacatatgtacatctaaccctttgcaggaaaaaacttgttaaatcatgattgagattatagtagtattatttctgattgactaggtagtaattggtcccagcatgtaaagtttctaatattaaagtcacacgatagaggagctagaggcttaagaaaagtrtacatgaatttatttatttggaataggaagggaaacatccctggtatcatcatgatggcatatagaggcagggctgagagctagaatacagaatacgtcctttgctagaaacagtttctcgggctgggttagagtgggtagaaactatggatcatcctgccgcaggtccaagtaaacaggatttggcgctctacataatggctataaagaaacataaaggtgatttctccaagtgttatgctaggtgagaaatatttaataagtaagagcaatcagaattggtcccatattgagaaagtctgttttggagcccagactaaatagactgtgcagtgagaaatgaaaggtcaatttaggtaacttcatttagggcaaaatcatgacttaggaaatcatgactagataaatatccagtgaagagcagggagagaagattcatcaatggccgtaggttgctgtgaactacagaactgaaacatcaatgtatgaataaagtgctgtattgatggacagatgtgtgcatttttatgtatatgccataaaaaatctgaatcaatttctatttgaaatagagaaaagctagttcagatgttagaaacttttctgacgcaaaatattgtgtaattcataaacaattccttgtgttttagtttacagtatgtccagaatataggacttgcctactgtaatgtataaaacaaaagaacttcaggttgatttatttgttaagtagtagacattctcctaggatgtttatgtttgtgaagatgataaatggaagaatacatccacagaaaatgtagacacaggcccttctctcccagtctcaacaccacaccctacacacacacaatgccttccttctaaccttgtctatactgtctctgcaacacacaaagcatatgcccaggataagcttctctttcaaccacctatcaggctttcaacatgtggtttgaaaagatagtgacattgctatgctctgacatacaccgtaatgtcagtacagcagaagcaagtggaagattctacttttccgataaagatcagttgctgtttcctgtcttgaagacgaaagttgagcaaaagcaaaggtcatctgtgtttatattaacaatgtaagagttatactacattttcgcaacaacatcaggtcattatttatccacttgtcctttttttttttatcattcctttgaactgcctgcatttgcttatcgtgatatttctcagtctgtaaacagcccgagtagctgttctatttctctaaatagagtcttaggtcattttattatccagaattgtaagtcatcagaatgcacccatctgttgtccttccacatctgggctaactttaactctttaagcccatagaaaaagtagaaaagccattgtgatatgagtttgatacttttttcctaccatactgctttccagcatatggttttccctgaaaaatcacaaggaaatatttacaaatatcttatttttctttggacatggcattaaacgtggtagatcctccatctccacttggctctttctgattttctgttaccctaattatccttcctgcgatcacagctgctcagagcctcttcttaccaatttaaaaaacctctaaagatgtgacggctgcctttccagtggccaacaagcagatttccatagcagaggagctgcgactggggcagagagccaaagacagcttgtgccaacagccttgtcaatatgccaatcatcttgttacagtttattacatgcgtgacttgattttcttgcatgtgcgttttagaggtaacaacatattggtaaacctgttttcaatccttttgattaccttcaatttgatagctccttcagtaatgaagaaaaaaatgggctattgtgtttgaattacatttatcaaatgattctaagattgttctaacgtgtgcgacaggataagctctcttttagtcaccaattggagaaatatgctcagtgtcaaggaaatggagaaatgcctcattatttatgttgactaatgtataaatacaatatgaacaggggcggtttcaaccctgcaaacgttttcttccaagttgctctgtattttagctagactagactagattgttcagtggtcacaaactaccccaaaatcttaacagtttacaacaacggaagtttattttctaaatatataacatccactgagtgttggccagcgttgactgggggttgttctccacatcacgtccctaagggaccaacagtgttggaggagtctctcttctcatattgatgttcaccatggcaaaggcaatgatcacagtgaaccacatgctacattttaagcttctacctggacaccacacaagtcacttccactcccakttcggtggtaaagcaagtcaattcaagtctgacttcagcatctttgggaaatataattccaccccrrgaggggaagcagatatgggtgaaatgtaataaaattcacctctcccataaagtcctagtagcattgttttatttgagtgaattcttttttttttttttcttccttacagatcctctttaaaacatcagcctggaaacagtatctgtagaaatcagttttgttagttctaaagcagggcttcattgttgggatgtgttgtctgccttcgttagcagatttcaatcatagccctaaatggaagacacattttagggctgttgctgctatagaactccaggtctttctgcttaacggtttcacacttacgtgtgaagggaggacacccttggccaaaagaaccaaggctgctcagttagctgctggttgtcctccagcaaattcctagaactaaatacctggtgctgaggtgtcacgactcagcaagtcctagaacctgtgcttatgacagcactctgataattcccggttattgcatcactccctgatggaaacccagcttttatttcagcaaaagtaatggattgttccagacccctgacctcccttgaagatgtctttttgttggatctggccctgtatattttccagttggttcaagacctagagaaatttctacagactctctcataccaggtaggtttttgtttgtttgtttgtttgttttgcttttgggataggacctagtcatattcagtccacattggaaagcataaattagtgtaacatacataagcttgttcattccactccatgtgttaggtttttgttagtgaacactgactgcaaaaataccaaggtatagccttatgcaagccaacatagtcacgttggacattagtgatctgagggtggaagtgaaatgaagtacggttttttttttccaagtcaactaaacgaacaggctgtatgttttacaatatgaattgggttgtgatatacaaagtgtttatccaaagttaccctcctctttgttttttagaatgacaagacccaaatgggagaattaggccagaagcaacaatgccctcaggcttagtgaaattgaccaaagtttgaaggtaagtgttttcagaccctggtttcctaggaccaagtcttggcctcatcaaacataatcacagtctccttttaccactttggcccaaacactatgaagccttttgcccactggctcagcttctcttgccatatactgattattaatgccagtaaaatacctaggcaccttggcagtaacttacgcaaatatgtatatttctaattacagggaaattgttagaacatgacttggattagagatacacagctaataattcaagaagaaataatgctttgttttcagtagaggaaaataaaagcttcatttgaataatttttcctcctttctctccctttttgttttgatacttacgcatgggcaataccgtaaactggcaataaaagaagttatcgcaaacagtgtggccatttctcctcagacactggacatcctacatctgttatatggtttaccatccatccacttccttgctatagctccaggtccacaattctttgtcatgtcattgctcttgacctataccatgactgataaccatgtacatttttaagaaaaaaatgtaaattaattaaaataatttaaaaacacatatccatatggtgtttgtgcatatattttgctttttctaatcttatctttgtagttcaaaaaggttaaacctgaatgtgatatgtgtgtgtatggaaactgaatgcactataggttcaaataggcaaggaagttgcttagtaacatcctgttcttgactgtgctatcataatttgcattttccaataaagtgtgtttccagccttaggacagtgctactattattgctggtggattttgtaatgtaagcttgactcattcagtgtcaagatcacctaaggccaaattcccattccacacgaattctctttcaagggatgtcctacccttcaagatgcccttaagaattctggattccttaaatatagaactatttatgcttactcataaaacagggaatgttataatatttctctgcttcactgtgtccaaggaagtagagaaatctggtaccatatttatgagcagcaataaaccatgtgttttgctttttcctaaaacaagcctggcaaactgtttaagaacacatgtgcagagcttgggcacagggtgagagtttggtggcacggagtgaggctagaggtgggcgtgtggagagtctgatatcctgatatcaaagcaattccattcagacttaggcctgagctgctcccagtcatccaagtcatttttactaatatctgacaacttgcaaatattgtgttacgttcaacactgaaaatgaggactgtgcatttccttttgtytaaatgatgattaaatggtgaagcagctacagaagtattgactaacgacagcatccatttactagaaaatatgtcatttgctactgcaaacatttatggtctgattatacctcatgttacactgcaatggtttgggttttttttttttttttgtatttttggtacatcagaaacacttttcccaatgtttgttagtttaagcattgktcaacatttatttattaagcattgactttataaaataggtaccaggaatatgaaaatgagtaagatatgttccctgacatccagtagctcatagtctagagatgtcaccataataataactagcatttattggacaccacctgtgtctcctgaagcctgttacctcatttaattttgacaaaaccttatgaagtgaatattatcacacaaacacacacatttagagaatgaatgtgaggctcagagaagttaaacacattgcccatgatcacagaaccagttagtggcagagttgggatttaagcccagatctttctgattctagagcgtatgttctatctatgaagctcttaccgattttattttatatcaagtgaactgtgtaatacataaagtcactcaggaaacagtactggatggggattatgatactaggcagtgcttactctagcaaataggtatcagagccctggcataggtcctcacttttgctaggattctgtcctactccacccttgctgataaacgggaagccacacgtcctggtccagcacttattctcaggcctcccagggacactcactctccatcacgtagtctcttccctaagtagtctgtgtttccctctgccttgcgggtaacttcatctgtgtgtaccaaacctgtcacccctcttagtagtcctcaaaagacaagacttcaagggagagttaatattctcagagttcatcagaaatacctgtttccaaggtcaagacccaccttagaaaggaggtcttcatataccctgtctgtgcttattttgtgttttcacaacacaaaatattttaacgatgatttaatttagttgtgtattgatagtctctgtcaatctctcagggttttttttttctgagggaaaaaattacattttgtaattttttaatttagaaacaacagcaataacaacttgagtcggtgacttctgaaccatttttgttctgattatcactgtaaacctaaatgtgtgaacactatcagtagggataatatttaccctatgggactgttaagcaatttaagatgagataagaaatgtcacagggaaaaggtgttactccacacatggtagtcgttattatttattgggttgaagtgttggcctcccaaagggcaatggtgatttaatagaatataagcaactaaatcccaggttaaagcagtgaattcctaattgtagaattttccctgttaaactatcaggtgggaaaggcctgtcaagatgtatatggaaggagtgagatccttgaaataattaatacacctggtataactcccatcattaggtaaacctgggctcatccctactagacagtaatagaaaattagaggataaaaggatagtcacaaaaataaatagaatatattgaaagctaactatgtactaaacagtgttctaggcatattttacatttattaattcatttaaacctctcaactccctataaagtagacattactaattatctcccttttacaaaaaaagaaatctgaacctaagagagtttaaaaaatttgcccaagaccacataatcagaaggaagattttgaatctgatttttcctcacagcaaagtccatgcattttccactttatcacaccggtttttgtttttgtttttgtattattatttttgagacagagtctcattctgtcacccaggctggagttcagtggctctcagctcactgcaacctccgcctcccaggttcaagcgattcttgtttctcaggctccagagtagctgggactacaggtgtgcacttgtattttttagtagagacagggtttccaccatgttgcccaggctggtctcgaactccttttactcaagcaatcctcctgcctcccaaagggctgggattacaggtgtgagccaccgcacccagccaatcacactgtatttaatatcacaacgaagtgcagtctgcccttctcaggatgatcttagatctatttttcagcaagtcgcattcgggtggagcaaaagcttttaaatggtggtcaattacacaatgattaaatttagtttaccattataggtcaaagggaagtgggaagagtttgatgactgtgtatttgtcatgtttctagttatagtgtacaactctgcctgtttatctgagtgagtgccaagaggtgaggtcagggcaggggctcttgcacatggcacatactatctgccccacagctattttgacttggacagtcattgtgctgggtggtaaaaattccagtgggctgggtaggacatactggggccctgtttcctctcatctgtgtttgagaactaggcagcattgcatcaaatggaaggaacaagtgatgagacatcaggaaaatatcagaatgaaagagaaatgcaaggctctaaaggaagttccaactcacttcgacaccctccagttagcaaagaggtgacagaatcccaaaagggcaggggagagattatggatagcaggctcctggaggaaaaactaggtatgtccagtagcagatctgtggaaactattagaaaccgagctaattgtggacttcttagcatgcctcaggaaatgggaaggaacttttcccttttgggcttgtattttttccaattttccttgttcgggaaataattaattctttaagcaatgtaacctcctgctgtgatttctcaattccacaaaagagaataattatagattaataatggaccaaaatagaaaaagctaaatgtgtgtagcagataagtaggaaatgttctgtcttgtaaagggtattgtttcggtgcccggcaacacagaaacaattctcatctatgcagctctaaatggatgttagaattcacccctctttcctactggtataaaattttcagtctcagtaggactaacgctttgacacatcctaaacctcaccaggagtaggaaatatttctcatagcataaatattttttcttccttgaactgaaaggtttgtggccttccccatgcatgataactgggcagttttcagaatatacctcacagtaaaacttagacttcacacctgtaatcccagtactttgggaggccttggtgggcggatcctgaggtcaggagatcaagactatcctggccaacatggtgaaaccccatctctactaaaaatacaaaaattagctgggcgtggtggcacgtgcctgtaatcccagctacttgggaggctaaggcaggagaatcacttgaaccagggagtcagagtttgcagtgagccaagatcacaccactgcaccccagcctggcgacagaatgagactccatctcaaaataaaataaaataaaataaaataaaataaaataaaataaaaaacttagacttcaagttttaactattgaaaaacttccatgaattgggtacagtaccgagctaaacgttgtatatatgttatttattcaggaaatattttcaggtactatgctgagtgctaaaagcattgttctgccttttaatactaacaatgcctgtgaaaaatatgtaggattatccagactttataaatttaaaacattaggattcagaaaagtaatatgcacatgctcctatactttacatgtgacagactggaatcaaatggtttaggatgccccgaataactgaactcttaatgccccagaagcccagatcgggacccaccactgggagttacagccctctggagccagcttcagaggtgcacaggtttattctcttccctattcaccagtgaaagaagcccagagcctccattccaggcactctgtgcttcccaaagtaacaattacttaatttgacaagataatttaaagagattgccaaaataacttacaggagattgccagtataatcagccctcccatatctggggattctacatttccagattcaaccagttgaagagagaaaatatttgaaaaaaaaaatttaaaataatacaaataaaaacaatacaacatagtatttatatcatattgggtattgtaagtaatgtagagaccatgtaaagtatatggaaggatgtgcataggttatatgcaaatatgctattttatgtcagggagttgagcatctgcagattttgatatggaggcaggggtcctggaaccaacatcccatggatacctgagggacaaatgtaatcaccatgttttcccaggtggatttttaacagtggccttctggagacactatgcctatggtttagtctaattgttaaaaattgggataggtgaagaaagatggcagataggcacaatgggaggcagatatttccataaatgccttttaaatcagatcctttctagattcacttttggctctggatctggaagctatcatcatggcaaccccagagtcccattggtttgcctattggttaggtgggccaaggtgtccacatatcacaaaagagttctcaaaaaatttcttcccaataacgagggagatttatatttaagagcacctttagccaaactgaaggaagggaaagttcacaaatatggtaatagctcaagtcaatgaattagaggctttgtgtagggtaattgttgagacctccccagttgactgaccaaaacaattctttgttggctagcagagttagagaatagaattttgcataatccaagtatttcatataggtcccttctgctgttactggagcactagtgagctattgtatttgtggtcataatattagctgcataggtagttctataaatgtgtctggttaataatccacaaacgtcagtgttttacatttgtaagtaaagaagtctctgtccacagcaaaaacgttaccaggcaatattttttagcattaaaaatataaaataaaatcaagttacttcaaagttctaaagaactagaagtcaataaaattcataaatatttatttttcaataattctggatgtatcttaggatcctaatataggatgtacatcctaatatagttatgtttacctgtcatttattttaattgatatatgccagtacttctatagtaagattttattggtaaaatgttttttattcttcaaaatgcagattcctttcatagggtatattcatctaccattttccattctttgaaatctgaaataagtcctaaccttatacattcaccaggagtgtgtattaatcacttctcacactgctgataaagacatacctgagactgggtaatttataaagaaaaagaggtttaatgaactcacagttccacatggctgggaagacctcacaagcatggtggnaaagtgacaggcacatcttacatggcascaggcaagagagaatgagagcaaagcaaaagggaaaacaccttataaagccatcagatctagtgagacttattcactaccacgagtattgtgttgagggaaaccacccccatgattcaactgtcttccaccaggtccytcctacaacacatgggaattatgggagctacaattcaagatgagattcagatgggaacacagccaaaccatatcagagtgtatactttcattttattcctcaatcttcattccttaagttttcaacaaataatttgcttttgaaaggattaggagcttaagttggctttatagttatccagtaaccttttgatttctccaaccaatgatttgtaaaggaatcttcagattcagatttatcctttcctacttcatcttcaattgctaaattaagcatgagtcccatcactgagataacagtctttcttggacagagttatgccaggtctttttctatgtaaagcagtcatctattaggctgtcgttggtctgtcaagatgaaactgtgtgcattggatccatgtgaatgaacatagaacattatacaaatattgtatgtttctattctttgcttgaagcttctggttacttagatcttatagtgcttcatagtataaaaaatggttaaaatacttaaaagttttaaagataaagatgtcagtgtcacagtgcataactgggttttacatggtcaagtatacacacatacacacacacacacacacacacaatttaaaaaatctctgatgcactatgccatactcagcaccaatccccattacaactctcccaatgtttcctggccaggcaggtcaccaagatgtttgggactgtttatgcctttgcacctactcatcataatattgtgtggggatcaatgggagagatatttggcccatttttaagccatatcaggggatcttccacttcctaaactcacttagacttggaatttaagtctagactattttgtttttaaccttgctaacacctacctacctacctacctattcattgtccatagcctaggtagtcttgaaaaaccctccattcccgcagcttcccccaatgcctcctctgaactcagtgtcactcctgtgtgcctcctttagtgttttttttgtttgtttgtttttgtttgtttgtttgtttttgtcattgcactcaccaccttatattgtaaaagtctattactaaggaagtattcctccctcctttatgtgcagaattccttgacagaaaggataggtcatgtttacctctgtcttgcctccaatgcgcagcatgaagcctggctctatgatcagctctaaagaaatgcttgttgatgggcaaataaactcgagaatctcacaccagagccagaccggaagtttccttcatttcatgactggttttcacaaaaacaagcattagggagagtggaaggaagagcttgcaaaataccttactactgcattatgaatgtggagttgtaattttgaggttcttatccatgaagatggtccttaaaattcagaattttaattaccaacataacaccatcctttcttactagtatcattattttatactatgttttcagtaggacatatctgatggaaatacatttcttttgatattatttattataactggtgagctacattccacccaatagtaaatgcctctcagcaaaaagatagatacttttgatagttaatatattcagatattatgttgtttgtggaaaccataacttaataaattttaaaacagtgtcttctttaaaartaattttttattaaactttgtattttgaggtaattgtagattcacatgcagctataagaaataatgcaaacaatactttttacccagtttcctccaatggtgacatcttgaaaactatcgcacaatagcacaactttgatattgacactgatacaatcaagatacagaacattttcatccaggcatcccctgtgcttagcccttttgtagctacgtctacttcctttgcccaccctcaccttaaaaccctgscaataattaacattttgtcatttcaagcatgttatataaatggaaccatagagtatataactttcaggtattggttttttccaatcagcataattctttggagattctttacttagcatacttctctggagatttatctaggtgcttgtgtactagtagttcattctttgttatcgctgcatagtatttcatgctagggatgttgagccatttacccattgaaagatacttgggttgtttctagtttggggagattataaataaagctgctataaatactcatacacagatttttgtgtaaacatacattttcatttctctgagataaatgcctaggaatgagtgtgatttctagatctgatagtaattgcatgtttagtgtttttaagaaaccaacaaaatattttccaaaattagatgtgccattttatattcctaccagcaatgtgacagcaattgtttttctgtatcttcaccagcatttggtggtgttactttttttattttagccattatgatcagtgcatagtgatagctcattttggttttactttgcatttctttagtggctaatgatgttgaacatcttttcataggcttatttgcatctgtatatcttctttagtgaaatgcttctctgttcctgttgcctattttctaattagattgttttttgactgttgagttttaagagttctgtatatattcttgatagcagtcctttgtcggatatgtgatttacaaatattttctcccagtccatagcttgtcttttttattctctttactgtttttttccacaaggcaagagcttttaattttgataaaaataactttttatacttaattggcaaccaaatacctaaatgtcttttgatagaaaaacttgtcctagataatgtaaaatcattttacatattcacagatccatctccactaatgtcatataagtttaaaaatcacaaagtaatttgaacagattcctaaattataaatyagttaacagttattttttgctctaatctttagttgtacatttacttcaaataaacatttgttaaaaacgtactctgtactgaggaatgaggatacaaaactcataatttgtcatttctttgcttcagggacttacattttactggattacatctaaatttttatttggcagttttattccaggaagatcatgacagtcttgttttctaaatcttaactgccttttgatgaaaaagaaagataaggctttaatttctctagtgaaacctgaagaagtaaaataaaataacttgtatgtcccttcacaagccacagtcagaacactgtcacaatctcgacctttgctccccaaaccctattttgcaaaccagatgctatttctttggacattacaggctattttcaaaatacatcagaacttaacaaaacatcatattagctaaatagcactataagaaactgcttataatattaaaattatgtcttgagtttataattatataaaaattgaatctaccctagagcaaaaattacaattaactactaaaaaatcgaataagtgatttttttttttttttttgaggcagggtctcactctatggcccaggctggagtacagtggtgtgatcatggcttactgcagccttgatcttctgggctcaagcaatcctcatcctcccacctcaacccctccagtagctgggaccacaggtgcaccccaccacacctggtatattagtttattttcacattgctgtaaagaactacctgagcatgtgtaatttattaggaaagcaggttaaattgattcagagttcctcctggctggggaggcctcaggaaacttacaatcatggcggaagacaaacaggatgcaaaacacctcttacaaggtggcaggagagagagagagtgagaggggaactgtcacacacttttaaaccatcagatctcgagataactcactgtcatgataatagcaagggggaagtctgcccccatcattcaatcatctcccaccaggcacctcccctgacatgtggggactacaattctagatgaggtttggttgtggacacagagtcaaaccatagcacccggctaattttcttttcttttctttttggtagatatggagtgtcactatgttttgtttccctagctggtcttgaactcctgggctcaagtgatctgcccacctcggcctcccaaaatgctgggattacaggtgtgagccagtacacccagccaagaagtgatttgtataatggcaggattatgaatgattatttctgtgtctttaatttgatcatatttttaaaacagtcattatttttggtcatcatgctatatactacagagagcagtttttaatctgtgaacgtgtaagtcaacttgatttagctgaacatagcagagtcatcaatcaaactgattgatgactaagggtccgcagggtaacacatcatcatagttgtttccatggtgatgaattatgatgtcacaaactcatcaagactgtgactcagtgaaccatctagacagaggatgaaatgcagtagttcaccaacatgtatgccatctttgtattatatggtattattaattaaaacgaagggctgagtatttctttcattgagattacatgaagatattacgtatattcagacttgcctgaacacggctatgctggttttaaattgaaggttttcacaaagcaaaaaattgagaaacagaatttgacatagaattgtgtatttattagaaaagatcttttcttctcatattctgaaaagcacactcattaattacagttaaattcaggcaaatttggcaaattttcgtcagtatacttattcttttgttagttaatagctttgcttttcagttttagatattggtattaaatatataaagagaaaagaccttagtgttctcatgctcagagattaagagaatagttataggtttgaaattaggcactttccctgatagtttttgttggtacatgttttaggttatgtttctatgaacaaccagatgcaaacgtcctggcattcatcctgcctgcttgctgtttgtaccatctccgtggtagcaaccatccaagctgctggaagcacagactgagctctatgagtcaattattttatatacctgggaacgtgctagccttcctgtcactctttgatgtcactatgtagacagtttgcagcctaggcaacatggtaagaccctgtctccaaaacttccaaaaattagccaccaggtgtggtggtgcatgcctgtagtcctagctactctgaaggttgaggcaaaaggaaccctcaaccccaggagtttgaggctgcagtgagctatgatcgcaccactgcactccagtctgggagacatagtgagatgctgtctttaaaataataataataattttaaaaattaaaaaatatctagacaatttctctgctttcaagactcttcaaagatctcaaagagaagctttactctggagtctcaacagaggccattcaaaaactcaacctggtttttcaacaataaattagaaatgtaatgctaacagtaggtgccaaggccgaacatcagggaaaagacattagtgaccttgagttctagactagattttaccagtttctgaccttcaactctggtactcgattttctcataaatgtgagaaaatatcttaaccgtatcacagaattgatgtgagaattcaaaataaagcatatttaaagctcctaggttagtgcttcatttatgaaggtcagtgcttcataaatgatagttatttttttccattcaaaatagagataaaaaagactttatctcactaatgtgtcatgcaaataaggattaatcctgttttctattcctgaagcatacagaatgtgatttctttctccatcatttccatctgactatcatctgggagaacacacagctgctccacatctggtgcaacacaggcagatgtagctgtccagagggagaagagtgtttgcttttctccacctaaacactgaccctcttctgcttagattcaaagactgtcttccttctgcaggtttacctgagcctggactcaaagaattaccttcattatgagctaaaggaagtcaggcccattcttcttctgcctggcccctctggctctttggcacttcccacatcctcctcatttggaaaggcttcatgactttctggttcacaaagcagctctgttgttgcttatttccactacagggaaaaagtgaaacacttcactcagggcgcagaacaatggaagtccctggaaggaaaggcttgcaagagaaaaccaagtggcttctgagatattcgaaagtccagttgttttccctttttaaaaattttcagatgctctttgatgccatttcataaagcctgtgattgggccaaaagtcttagttcaccatgtaccacaaatagtgtactctatatagcatatgcttaactaagaaaaaataaagatttagaaatagatgtattgaggacatgccattaaaagcagcttccattgaatcaactgtttttcagagtactgtcaagattaccttaaactagtctaatcaaggtaggtggtggattccaaacttgggaaaaagtgagtctttgtattctgtgaagtttaataactacccaaggaagaagtgttggatacaacaactatgagtatcttagaaagtatgtcttttttttttttctgagtcagggtcttgctctatcacccaggctggagtgcagtgatgtgattataactcattgcattgcaatcttgaccccctgggctcaagccatccttccatcttagcctcccaagtagctaggactacaagtggatgccaccatgcccagctaatttttttcttaatttcatttttgtagagataggatttcccaggctggtatcaaactctcaaacttcctggtctcaagcagttctcccaccttggcttcccaaagtgctggcattataggcatgagccaccacacccagcctgggtgtctgtctttatgctaaatgtccgagcctttccatttgtcttttgcctcttcataaacctctgctgagctttatcaggtcattcacatctttcattacaggcaagtggtaaacttagtaatatgcttcctctggtgacaatgggcaaaggactagaagcataagtaaagaaatagtagactgaaataagcggattttgacatgcaaaaagatgcagcaaggtgaacctggttaagaaatagactcagagagcttgaacatggaaggatgctaggacaagtggcagctaaggcagaaagacagccatggttccagatgtctggggaaacaatggaaggcagatattacaaagttttccattttgtaccagaagtgtccgtatgaacacaaactcctagtaagtgttcttaattgttctgtgggctgatgtgcatttttctcctacaataggaactagcaatctacatattatttaccaagccttcctagatagaagcatttatgattattttttgtttatataaatgtcttgcatttactagaaaatcatgcttttcgagaacgcatttctattatggagtttcttaaagagagaaaaaaaaaatgtatggctttagaaaaatcctagtgattttttgacagtatgaactgtattgtgtgttcttgtcttggatcaatatcatggcacaatgctttgatagtgtctgaagattaagatatacaatacaatttcctcccttcccttctttcctttttccttccttcctttttcctttctttcttttccttccttccttcctttctttttctttctctctctctttctcttccctccctccctccctctctctttcctctttctttctgtctgtctgtctgtctgtctttttcttgagatagggtctcactttgtcacccaggcagaagggcagtggccctatcatatttcactgccacctcaaattcctgggctcaagggatcctcccgcctcagcctctcaagcagctgggactacaggtgtgcccctccatgtgcggttaattgtagttttttgtttggggtggttttgtttgtttgtttgtttttgtagagactttgttgcctaggctggtctcaaactcctgggctcaagcagtcctcccactgcaacctcccaaagtgctgggattataggtgtgagccaccatgtccagcccaataccattttcttatgtttcccatatatgcataattttacttgcatgcaattctgaatggatgaaacatgttttaatcacctatttttctactttgtagaagagccaaggtaacatgaactaaatcattaaagcagttgacttgttagtggattgtgataggactcaggcatttcccaaagggggaacccatattttggtaatcccagacattttaattatatttttctatccattcctcaatgccacaatgaggaacagcattctttcctgggaagtctcacaattttgtcaaaagtagaagagttgcctttgacgaatacaaatccagcaataaagaagaacaggtctaacaaatgaggccaccttggaaaatgtcattttgcccctttgagccttgcccatcttacctttagaggaagagatgggactgaatcagttcaaagagcctcgatagctttaaatgtctgtgattgatttttctgcagagcaagatcaaacaaaacagtatttcctagctgctgcccttacatgtagtggtgattcacagagaatttggggaggaaagtagccattatgggatgttttgcaaaaggcaataccaagattgatcatcacctgagggcgayacactatagttgttcctctgtatccatgacagattagtcccaggaccccttgcagataccaaaatccacagatgctcatgtcctgcttataaaatggcatagtatttgtacacagccttgtatatcctcctgaatactttaaatcatctctagattacttataatacctagagttgtataaatgctatagaaagtattgttatactgtatttttaaatgtacattagttttattttttttccgaatacctttttatccatggttggttgaatccacggatgcagaacccatggatatggagagctgactgtaatagtcaaagacaagagtggctggtggtaagcacactatctgtccacaagtgaatttcccctaagaatcctgctggtacatttcttcatttcttgagattattgaaccacgtgatttgcctcactgcttatttcaccttctgggtgacatgggctgtgaatgtgcagttcaaggcctaaatattagccctgattcaaaatggacattaaccaaaaaaacaaacaacaatgatactggccaactgacttctctcacttctctcttctcttttctttaattcattccttacctatttagaatagctgaggctcatttttatcttcttatgacagccagaattgtcatctattaagattaagtaaggaaggcataattgatattcacaaaccaccccaggatttatcagaagtgagggwgtttcatatggattactaattgtctaaaatttggctctaagcacctgaagatcactaggcaggagagaagagtagggtttgttgtacatgagaagaggctgtggggtgggggatgttcaccgagaagactgctttggtctttgatactagcatttttccttctatatggttaacaaggcacatattttcatttttatatccccagaataaaggcttgaaaggaaacaaaatctcaaataaatggactaatttgttaaattctggactaaacctcagtttattttaacagctttaacaackgtctctggagctcataacacatatagagcactattggtgtcacacaaaaccttgaaatcagaattgccacagaccgaatctgatctgaaatggcatttcattcaactgcagctttgtgtcacaagaacctgtctctgttttcctaacatgggtatgatgcatattcagaagcagccgagtgatttacttcttttttcattacgcttgtggatttgcatagattcagaaggggcatcttctgggaggtataagagtttatagaaagactaatttcttgactaggcacgatggctcatgcttgtaatctcagcactttgggaggccaaggtgggaagatcacttgagaccaggagtttgagaccagcctggccaatatggtgaaaccctgtctctacaaaaaatacaaaaattagctgggcgtggtggtacatgcctgtaatcccagctactcaggaagctaaggcacaataattgcttgaaccagagaagtggagattgcagtgagccaagattgtgcccctgcactccaacctgggcaacagagtgagactctgtctcaaaaacaaaaaaaaaaaaggaagattgatttcctgtagacagaaggagtgtttatattggcagcagcaatgcagtatcaaaactttggggtcaccctcttgaatatcttatttgtatttcttcttgggttactaaagtcttgaggagaaaaatgaataaaaggcttaagaggattctcatttccatgcaaagcttctccacactcctgagagaaggttagggtcaggaaggaaggtcagacaatataaacctcagcactattcagtaaaatagccatggggaaaaatatggtaagtttgtcttaattcatacccaaggacatttagcgctcagaaaactaaaatactttttatttatttatttatttatttatttatttatttatttattttgagacagagtcttgcactattgtgcgggctggagtgcagtggcgcagtctcagctcactgcaacctccacttgaacctccaggttcaagtgattctccttgcctcagcctcccacgtagctgggattacaggcgcccaccaccacacccggctaattttttttttgtatttttagtagagacggggtttcactatgttggccaggctggtcttgaactcctgacctcgtgatccacctgcatcggcctcccaaagtgctgggattataggcataagccaccttgcttggccctaaaatacttttaataagattgtctcatccttctcttggttttccaatggaaatggtggtatagcaagtccatctgaaacacttctgcaaaataacaatgaagctaatcacygtgggaaacatttacatcatatgtatttgcatacagaggaaattgataatcttgagacatcagcatactagaatagcaagagacatgttttattctattatattctcttagtcagcaatktttaattgttgcttaaaggaaactgaataaaacgtgggcgcagtggctcycacctctaatcccagcactttgggaagttgaggagagaggatcgcttcagcccaagagtttgagaccagcataggcaacatagtgagaccccatctctacaaaaaatattttttaaaattagtcgagcatggcggtggctccctgtagttccagctacatggagggctgaggtgggaggatcacttgaaccagggaggtcaaggctgcaccctggcctgggcaacaaagccaaaccctgtgtcaaaaaaaaaaaaaaaatacgtaaagcaacagtttttctataacggattgcatggtaaaaggaaggatgactttcttactataactccttatgataattttttccaaagtgttaatcttaggggttgaaatttttataggtaatcattaactttagtagaacattattttaaagtttaggtatttcatctgagtatattactctggctttcctaagctagcttagttatatatgttcacttcagtttgagtctccactaaattttaacatgaacaaaatattatatgcaacaccatagaagcaattgttaaatcattgttacttttaatatcacctaaatctaacctaagtaaatgygtttatttttattaccaactgatgtagatatacccacatggacagaaaacagcataaaccaccaaaaggacttgaaaattccctcttcaagacttcttttgccaatgactaatgtttaatgctatttgctagagattctggtgccaggaggatttctaaccaggttattttatcaataggaataaaatatcgagggcttaaattagtgtaatctctcaagatcttgaatttgacrttttcataatttttacttaatcatagctcctggggattggaattactcttttagctggcccgagtctgggaggaggatccaaagtctttgagttgttttcttttatttctttttagcccctaaagcactggaaatggttggccctgaagtgctcctaaggtaaccgcaagatgaggcaaaacaggattgagatgaaaaccaagctcacccacatcctacgtcaattagctatttttttttctgtgtaaacaatgggagggaggtggattgtagcttttatggtagaggttcctcggcacctcctgacgcccccaggggtcccccctgccactgccctcagcccaaatataagctgacaacaaaatgtttcttcaaagtgctcattgtttactctattctggcttcttcttaaaggtcatcatcatgttgaattatcttgagaaaatcctctgaagtgtatgtgtgtgtgtgtgtttaggaaggatgtgaggaggattgggaggtgagtctctgaataacaagttgaaaaaagagtatggaggaaagcggtgtttaaaattgtccaaagccatcggccgggcatgatggctcacgcctctaatcccaacgatttgagaggctgaggtgggaaaattgcttgagcccaggagtttgagaccagtctgggcaacatggtgaaaccccatctctacaaaaaaagtacaacaattagctgggcatggtggtgcatgcctgcagtcccagatactcaggaggctgagatgggaggatcacttgagcctaggagtttagggctgcaatgagatgtgagtgcaccaccatactctagcctgggcaacagagcaagaccttgtctcaaataataataataatatataaataaacaaataaataaaattatcctaagtgaaatcagttgttgatagaactgaagtacatcaagcctagtgggactgtggttgtctctccagcctaaaaaaaaaaaagaacaaaaacaacaacaaaaaaacttaactccaaaattgctgytgctccatttatttcaggtgtaagacttctttgagatttaaaaacaatataatcatttacaatgtactttgttggacctaagcataggaaaattcattcattcattcattcattgagtacctgttatatgccaggcaatgcactaggcaccatcaaagatgaataagctatgtgctaaaattcacagtctaacagaagaaacatgaaagcagagtggaaatatactgtggcaatacatatttggatatactggtattaaaaagtaaggatgtttcagctaaatcttttttggtgtttattttttaaaaattcatctattaacttcctacacaccatgcatatattcagctaaatcttaaagtatgagaagaaacatgccattcatgaaagggaagagggagccagtgcatcagatacaacctatgcaatcgtgaagatttatggcagagcacaggatatttggggattggcaggcatttcaaaatggctggcacataaagttccgggatgggaacaggctggcaagagaagagatcatcggagccaaagtaactgaactgtgattgaattttagatatgataatatctataggaaacctggcaacccggtgggcaggtaaatatgatagagcgaagatagaatcttcaggccttcaggggactaagcaggaatagaataattttattgagcactttaagtggacattatgctagattattttacatatttcatctcctttaatttacaccacaaccctgtgagtgcaggttgataaagaattaaataaaatccaggtgaagtagcagcacctatagttccagctacttgggaggctgaggtgagaccattacttgaggccaagagttccaggctgtagttcacaatggttgtgtctgtgaatagccactgcactcctgcctgggtgacacagtgagacctcatttctaaaaaagaaaaaaaaaattgagacagggtctcgctctgccacccaggctggagtacagtcacgcaattacagcttactgcagccttaacccccaggctcaaacaatcctcccacctcagcctcccaaatagcttggactacaggtacatgtcaccacacctggctattttttgtattttttgtagagatggagtttcaccatgttgcccaggctggtcttgaactcctaggctcaaatgatcctcctgcttccaccttccaaagcgctgagattatagacgtgaaccactgcacctggtctagaaattatttaataataaaaaaatgaagacagaattcaatgaagagcrtagaagagtctcttaaacctytgttttaagctatgagccaggaaagagatggtggcaagggtgagatggttgcagtgcttttttgttcacttatctcaggcctgtgtgttctgagttaaagacaagtcagttggcaagagaaggagagaggaagcttcccagaaccatttgaaggaaaatttggaaagtcttctctaagggagttgccctcaactaccttttaacacaaatggaggactgaaaaacaaaacaaaacaaaacaaacaggaaggaattgcagatatacagatctttggcctttcaaactatggtatctcttagtactattttatatattgataataattataatttttctcaaacttcccaaaagtggaacattgtgggaaataatatgggagtggacatttgaatttctgtttgactttgcagcagaaatctcttttctaactctctctttcaatctcaccatcagagccatctgattgcttgataacatgattctttttgcccagcccttgttatcctccctcctgccctagtmaccatgacataggctccactcatttctacctaggaacctggatgcactgctttgcactattgcctcctggcaaaacagggcaatgagaaaggaaatggaagcccaaattcagagccctccttcccagcacaagaatgaggagatgccctttttccccggggagggggattcttccctctctcttcagtaattgtctttatcactgtcatgttctagccagtctttattatccccgccacacaaatttcatgttcttctggcagtcaaatcaggaaattcaaggacacaactgctctggcttcgtaaagatggggatcaaattgtttgagttgctgatagcaactctttgcttcttgattctccatgcctcctcaagcttttttggctgaacttttagccttggaacagggtcactggaaaatacttcttaatatccttaaattctaattctaatatttgccttgtttcattttgtttatttggggaggataaagtttaggtgttcacctatcaaactcacttccttcttttttttagacaaggtcttgctctgtcgcccaggctacagtgcagtggtatgatgttggctcactgcagcctccacctcccaggttcaagtgattctcccacctcagcctcccatgtagcagggatcacaggctcgtgctaccacgccccactacttttttgtattttttggtagagacggagtttcatcatgttggccaggctgatcttgaactcctgacctcaagtgatctgcctgcctcgacctcccaaagtgctgggattgcaggtgtgagccaccgtgcccagccctaacttccttctgatcaagtcattctcaaaaataaacatttaattgactgtcaactacaatgataataagacaatgtttgccttaaatgagctctaaatctagttgaagggataacacatggaatggactggtaataaaaagtgggctttgcttggtgctacagttgtgatgtgaactaaagagggagtgttttggactgactttgagttggggaggctttatggaggaggtgacttttcagttgggccttacgttgtattttatgaaataaaaaaagaggaaagacagtccaagatgagaagacagtataaataaagggacagaggcatggaagggaatttcttggccaaaggatagtaaaaagtacagaaccactaaagtctagagcacataggctagaggctagaataagtgagaaatagctaatcctaggaagataaattggggcttaattgtaaaaacctttgcatgctatactaagaagctttgagttcattctcttggcaactatgagccattacatgtttcaaaagatagatctgatggaaaaacagaagtatagagggtaggtaatattctaatgtgtaaacttctactgtgagtccaaaagaatatggtatctatctctgaaccatgttcaatattttgcttagactgttcgaactatgtaagaataagaaatactaaagtgttttttctctgatataatatttaaataccttttagctatcaattccttctaatttccctttaataagacatttactacaaatagacatcattcccatagcaatcttttcttgagacaaagaggtcagtaggccaggttctgcatagaatataagctatttttccattttagaatgccactctccattgatgtctactctcgttaagtagaaaattccaagaagtactaacaaaattatgttaatttgtgtatgtactgacttccagacatttggaaccagattctgaacctgtaactcatttaaatcttgccgtgactttggtttcccaagttctaggtctttctctgaaaatttaaaatgcttctggaaagatattttccatgacacttttgccttaggaaaaaaatttttggtcaacattggaagaaaaaaaaactgagacaacatatatcttgctccttaacatattctgtatgaaattaaggtcttattgacaatctacgtatcagagcctcgtacacaggagctattgaaatgatgtgtcagttcagaaaatcatgttcattatttctgattctcatcataaacaagcagtaaatcaccgtataaggggtgtatgcattagggcctcccacataaacttcacctctgcgtgtgtaaacattttcttattatcgcaaataatcaacaggagaagagcaaatgcaagtttagcttttctccagaatgtttatcatggttactttaaactgtttataggaaagagtgaactataaatgtctttcaggaggtgggtaggaccatatggctcagaggcttttctgcagtaaaatgtttggttaaattttaggcaacagacagtccttccacagcaattatttgtgatttcgagcatcgttgttgatactcaactcctgaaacaaataacaccgacctaaaacatttataataactgaagaaaccaggttccttttaaccctgctaggatccagctgcccccttgcaacccatccccagtcagctgcagctcaggcaagcccagcctttccatccctgcacatcagactgtggtgcagagaaactccctgtgttcttcaaaacaaacattggatgtaatccacctcaatcttttccatggtgaggctttacaaattttagttttctctaagaagatagcctgtatattcaattgcctgggtaaaagtttaatttctgatgcgtaaagcatatcctgccttgaaaaatatctcaggaaaaataaaggccacaacagtttcatgtgtgcctatatcaggattgctgctgagtaagttgtgaaatgtttttggatttctgagccatttggatttcagaattgtggaggaattctggatctgtattttattgtgtattaccaattattttcctttctcttttatgtgacgggtagtattttgattatttaaaatcatctttgtagaaaaattattggcagctatgaatttcatttcaagatatttaagatgccttagaaacttttctaaaaacagtataataggattgagaaccactcatgtatggcctttactgtttcgaggtttttcttttttgacatgtattatttgatgaaaccctatgagattaggtctttacttccgaaagaagaaaaccaaattcaagggcaattaaaaacttgtcaaatgtctcaattttagtaagaaaaaaaaccgacattggcctagatcttaatctgtgcccagtcctcttcccatccctctttttttttttttttttttttttttggkgggctgctctcaaatttttgggctcaaatgaacctcctaccttggcctcccaacgtgctgagattacaggcatgagccaccgtgcctggccagctaaggttaatttagtattgaaraaatatttttgttatgaatttagtgtagccaagtgtgcagtgtttaraccatctacagtaatgcacattaatggcctaggccttcacattcactcaccactcactcactgactcacccagagcaatgtctagtcctgcaagctccattcatgggaaaggcctcacacatgtataacatttttttgtcttttattctgtatttttctatgtttagataagtttagatgtataaatacttatccttgtattacggttctctagtgctcagtacagtgacttgctgtacaggtttgtagcctaggaacgataggttataccatatagccaaggtgtgtagtaagctgtaccatcttggttcgtgtaaggacattcagtgatgaaattgcctactgacacatttctcagaaggtacccccatcgttaagcaaccattactgtattagaaagcagaaaaacaaattcagctccggacttagcctacccatatagcatcattggccagaagaaaatcactttgctttatgaatcccagttttctgcgggaatgaaatgaggtaccatacgtgatcctaccagcataacacctgccaaatagtgcacattcaatactaaaccatcctttttatgcctataaataaaggatttgtactatatcaagagcttctctatgtctgaagttacaatagagtaattccaaattatctttcatggaatcaaatccctgatgatcccttgattttctgagttctgtgaatttcatcacagcccaatttgacccattactgctaattcagtgtttttattagtaaattatatttccaagttgaatcaaaacaacagtatagcaggcacagcttaagacacaagataaataagttgttgcattcaccagtcaaaatatttttaaaaaatcaagaagcaatcactgaatagttttccttgatttagataccaattaggtttaatgaccaaatgagactgataatcagagctgaggaactcaatcaacaggattgcaacatgctttttttaaacctcttgaaagatcacatcactacagaataaggaaacctatttatttatttaatttgagacagtctctctctgtcacccaagctggagtgcagtggaatgatctcagctcactgcggcctccaccccagttcaagcaatttcatgctcagcctctgaatgtaagctgggactacaggggcacaccaccacgcccagctaatttttttgtatttttagcagagacaggttttcaccatggtggccacgatggtctggaactcttgacttcaagtgatctacccacttggtctcctgagggaaatctatttatgactaatgctgttctttttactaattgtttcattggctgtcagcccttagaggaaaaactgttcaaacaaccttttattcatagacccatgttatttaattttagaattatttcccatgtatgcacaaccgaattttcattttcataacaagaaaacaaattctttaagtgagaaacagtacattttacacccttccttttcacaaaaatctcacagtattttctgacttatggtcttgataattagcactcctgtttgctcgtgttctctttctttcacaagcaatgtgatcttatttttaaaaaggacctgagacaagtagacaattgacccttgaacaacacagatttgaaaagttttggtccacctatacacggattttctcccacctctgccacccatgagagagcaagaccaagccctcctccataccctactccatctgaagatgaccagggtaaagacctttatggggattcacttccacttaattattagtaaatatcttttctcttccttatgattttctcaataagtttcctttatctagcttactttactgtaagaatacggtatagactacatataacacacaaactatgcattatcaactatttatgctgctggtaaggcttctagtcaacagtaggttattaatagctaaattctgggggagtcaaaaggtatatgcagattttcacgggtggttggacccccccagcatccatgttgttcaagggtcaactgtatatcctaattgttatttgacactggaagaaattagatctcctggccgggcgtagactcacgtctatcatcccagcactttgggaggccgaggagggtggatcacctgagatcatgagttcgagaccagcctggccaacatggtgaaaccccaactctactaaaaatacaaaaattagctgggcgtggtggtgggtgcctgtagtcccagctactcaagaggttgaggcaggagaatcacttgaaccctggaggcagagattgcagtgagatgagattgtgccattgcactccagcctaagtgacggagtgagactttctcaaaaaaataaataaataaataaataaattatatctcctcttagaagtttgtccctctcttcaactgaaatctatcacagttcgacctacatggtagttgcattgatctgtccatcctggtgccacatatagaacatctactttgtcagatactgttccacatacagtaagcagaacacatgatcccagtccacatgaaggatggtgtccagtcatgtatggcctgattcttttctgtaaagtgctttcacatttgtagttggttcctttcctagagcactcctgtttttgcattcttgtagaaagcaaattatttccaccctgtcactgatttttttctccaattcaaacaatacgaactagaaaagagaactcccttgtaatataaaaggaaatagaaatccctatgtattcaatgtttttaaagtttaatatgattcctcttagcaataaccagcaaaaagaaaatgtttctactttaatcttttcttttgaactgaagtgttcctctatgtcatttacatgacaattggcccaaatctctctgttaccaggacttggtattcaaagtaagaggcttcattaaatttcaagaggacttttttggggaaagtttttgtttgttttgttgtgttttatcataacaaaacaaggcatagtgaccaggaagatggagtttctagttagtgcatacatatacatgcttatggttacttaatgtgatagaagcaaattattcagatgcctcttctccacagaaggttttggtcttcagcacgtaaagcaacttttttttttttgtttttttgagatagagtctcactctgtcaccaggctggagtgcaatggtgcgatctcggctccctgcaaactctgcatccggaattcaagcgattctcctgtctcagcctcctaaatagctgggactacaggcacgcaccaccacgtccagctaatttttgtatttttagtagagacggggtttcactatgttggccaggatggtctcgatctcttgacttcgtgatcctcccgcctyggcctcccaaagtgttgggattacaggcatgagccactgtgcccggcctcatgtagagcactttaaaagtacattggatccatagtaatcacttaactatgaacttgtatatccatatcaaaacttcatgttgtacagcttaaatatagacaataagaataaaataaataaatgaaaatattttaatatgctgagccatgttctggccatttttctctggccttatgtagctttagcttttcattctcaaagcatggatcaaagagctataagaagaaattaaccagagactttatcctgattgtttcacatttccaaaggcaataaatcagtcatgggctgagagaagagaactgaagtctaccacaacaaatatatttctgccattttttcttttatttcctataggttttgctttatgaattttgacatgatattttcatcatgtgtagatatcatacctctttatgcttttattgcaggtgaagtcatttcctaacatcactgctccctctcccttctcccagcagttatctatgtgaaacaaataaatgttatttgtgaggttcagctaattcagataattagcattaccaagaggcttacaattattctggaatttgtgtttgcttatttgtttccccaaatacagctaaaggagaggagaggatcaccagatcttatagtaggcaaaactatgaattattagtaaatcttcctcctggctttctatctcactggctgctcattctcattgtccttcactctttctcctctgtttaacttccaaatgccaagcatccctgggagtattctcttcatttattacattcactcaaatggttttaaataccatacatatactgatgacacctaacactctagttctcgtctgtgtctccctgaactccagactcgtaggtccaactgacttctgcatatggctgtccagtcggcatctccaattgaacatcgtcagaacaaaacttcaggcttttccccaaccagctcttctggtcttgcccatctcaataaacaccactgctatctrcccaattaattgagccggctatctggtagttattcccttctttgcctcactgtcttctgatccccatatcctataaactctaataccaagtatccctggaatcctttcagtttttcctatctttacttcttctccttagtctaagctattatactctcttgcatagtttagcggtagtttttaagccctttttttatttttattttacgtttgccttttctaacaaattctccttaaaacagccagaatgatctctttgatgtatgatttagccaagtgtggtggctcccactagtaatcccagctactccaggaggctgaggtgggaggattgctgggagttcaagaccagtctgggcaacatagtgagaccccatttctaattaaaaaaaaaaaaaaagaagaaggaaacatgaattagattttgttgctcccttgtttaaactctctattggctttttacttcatttagaataaaatgaaactccctgtcctggcccctatttgatcttatttcctgtcactttcccattgtctgttatacctcacaatcactggactgcagttattgctgttcctccgaactacaggccttagggcctttgcaattgctattttctatggctggaacactttctcctcagatctgcaaaagattggtatcttgtttagtcagatctcaaattaaataccacactctcatagaggccttctctcacctcaggctggtgttggtagcagtcattgaacttcacaacaccttatgttaatgttgtgcagaacacttaccactgcctgatattttactgataggtcttttgtctgtttcctgccactcctgcccctgaaatagaaagcaagctccatcagagaagaactttatctgtttgttcacggcagtaattccaggccttggaagagggtttggcacacagatgttacttaataaacataagagtgaatgaatgaaaattgttagaagacaccatctaaagtgagtcagacaatatgtccagcttcttgtgtgtgctaattaatgacactttgtggactatatatctgtatataactacttcatttcttacagagccttgatagatgaaagtaactagacatttaacttaaaaggtgctaggtcatcttcagttccaggctgtaagcattaagattgactgtacacgacctgttaaaaccattttctgggaaaggctcttaagtacctgtcagagtttacaatttgagagcaaacataaataaacccaaacgcctttcaactttgaacatttgatgcttgaaaatcacctctatttaaatttttgctagtcacatcttctcatcttttggtttcaggacctgattcatcagtttctatagatccatttataaactcagtcagcattttactttgccagcctatgagcacaagtaggcaactggaggcttggaaaaaacccagacaacaacaatttgtttttcactggttctgctttcaaacaacttccaagagcacaatacagcaaaaagtgagagttatctatttctcccttcttcatccgaatacaaaatacatcctattttactgctttttttttgtcttttgcctctactttaagacttatctaagaaataaagaaaagccaaccactcgttctatccacagaagaaaaacacacaccagcatagacaacacaaaagactrtgtctagatgttaagactatatatcctataggactataattttcatagatctaaaaagtgagaaacatatatatgtataaaattatgtgggatgcaagttactgagattttgaatatggggctctgtcatttaccctaaaatgttcagtggtcttttctattttttctctattctcagtaaaatagaactttctcaacaattctggctcctactcttccaatgggctcagcttgtctcatgatttaatagtactaaaaaccttttcttaaaaagaaaaaaaatcctttttaaaaaagtttaggtataaataagaaatttctatattatgaaagactggtttgcaaagaaactttaatatcttctggatctcatctcaatcacagtctatgaaggaaataaaataagtgccttctaaaacggcctattatactactatagctgttgtctataaggaaaaagtttgttagtgagttgtattcaatagaaaacctcaaagatggctgggcgcggtggctcatgcctgtaatcccagcactttgggaggccgaggtgagtggatcacttgaagccaggagttcgagaccagctttgccaacatggagaaaccccatctctactaaaaatacaaaattagctgggtgtggtggcgggcgcctgtaatcccagctatttgggaggtgggagaattgcttgaacctaggaggcggaggttgaaatgactctagatcatgccgttgcactccagcctgggcgacaaaagcgagactctgtctccaaaaaaaagaaaagaaatcctcagagaagatatcctagaactatttagttttcccttaatcgagtctgaaaacctcctgtgcccttccaccacttaataatctaaccaactattgtaaaattacctattcttctaaaccaccaaatagttcgaatagaatagccttagatatctaataactaaatgaaaccacagtttacctctctaggcttcagtttcttcttcataaaataagaagcttgaactcgaaaagttttagatgcgaagttcccaaaaatctagtagaggaagcaaaactctgtttggcaccctgtttccttgccctggacttttagcatttctttcttctggtgtaaagtcaaacaaaaaatagagatgaatctctaaatttacctttttattggggagataagagttgcaatacagggcatacacacagacctgatagtcttctgtatgtcagaagaacaaagagaaggttggaggttttacgaaaaggagaaatgtcttgtcctgaaagaaatttcactggcactagtaaagttgtggggagtggcaacctctgattggtgagtgacaacagtgcagtaggtaaaactaatcttagactcacagtggttgtcttagctgctattagataaaagtgatttcaggttacagcaggcagtttcagcagctaggtttgcagagaattacattcctagaacatgatattttaatatacatatccattgtgaaataaatactataggcaagcaatttaacatatttatcactttccatagttaacatttttgtaagagcacataaaatctacttattctgcagattttgaatatacaatacaatattatttactataatctttctgttgtacattagatctctagacacactgattctttttttttttttttttttttttttgagacggagtttcagtcttgtcactcaggctggagttcagtggcgcaatctcggctcactgcaacttctgcctcctgggttcagatgattctcctgcctcagcctgccgagtagctgggattacaggcatgcaccaccatgcccggctaacttttatattttgggtagagacagggtttcaccatgttggccaggctggtctcaaactcctggcctcaggtgatccgcctgccttggcctcccaaagttctgggattacaggagtgagccaccatgcctggcctagacatacagattctacatgattacaagtttgttccctctcatctactttccattttctcctctccctgcccctggtaaccaccattctactctctgtttctatgtatttgatttttttttttttttaagattctacatgtaagtaagatcgtgcagtagttttgtttctatgtctggcttatagttcacttagcaggttcattcatgttgttgcaaatgctagaatctcctttttaggttggataattattccattgtgtatctataccacaatttatttaccgcttcatctgttaatggattcttaggttgttttcatatcttggctattgtgaataatgctgcaatgaacgtcaaagtgcagatatgtccatgaggtgtttatttcatctcttttgggcatacccagaagagggattgctggatcatatggtagcagaatgttttatttggaagggaaacttttatactgttttccataatggctataacaatttgcattccctctgaaagtggacaagggttccctttattctacactctcaccaacacttgttatctcttgacttttttatacgagtcagtgtaactttaaatccacctggcctgatgctaaattatgaatgggaaaaattatattaatacttagaatcctgactgggtgcagtggcttatgcctggaaccatagcactttgggaggctgagatgggaggatcacttgagccaggagttcgagaccagccagggcaacatagtgagacctcatctctctaaaaaataaaatattagcctagtttggtggcacatgcctgtagtcccagctactcaggaggctgaggtgtaaggatcacttgagcccaggaggtcaaggctacggtaagccatgattgcactactgtactctagcctgggtaacaaagcaaagcaagaccatcttcacacacacacacgaaaaaaacttagaattccttttttttttttttttttttttttttttttttttttttgtggtagggtctcattctgttgccaggctggagtgcagtggcgatcttggctcactgcaacctctgactcccaggttcaagtgattctcctgcctcagcctcccgagtagctgggattacaggtgcctgccaccatgaccagctaattttttttgtatttttagtagagacggagtttcaccgtgttggccaggatggtctcgatctcctgacctcgtgatcctcccgcctcggtcccccagagtgctgggattacaggcgtgagccatcacgcctggctaaacttagaattctttacattcaaataatgtctggtatttttttacattattttcatgtatattccctaatttaaacttatccccacccccccccaccccaccatgatgtcgtcaacacagaactgttttctagattaggaaactgaggatagggattttaagtatctcgctcctagatcaggaccgcatccaggttgcagaatcccaatccagcactcttccacatagtcacagcactaccccaactctaatctactgatgacacagaacaaaattaaagtccttgtccaaatcccagagttcatgaacacagagatgttaatgctcctgtagttcatactgcaaaaagaatgtgagagcttgtttcatttttcacttagaaaatgtatgagatgttctttctgaaggggttctgtcactaacaggttgcattacttgtacaaccattatatctgaatcttcccagaccgtggtttttttttgtttgtttgttttgttttttattaaatactgtcattaaaccagaactcatggatatctatgtcatttccagctataaaattctagaaacttggggattttacctttttgtttcttattttattttcttttttatcaaaagccttatcacaggtaaaatggtaatctaagcaagaataagctctgtcatgatttatgaagcatggaaattcagctgtggccaggcacagtggctcacatctgtaatcccggcactttgggaggccgaggtgggtggatcacttgaggccaggagttcgagaccagcctggcccacatggtgaaaacccgtctctactaaaaatacaaaaattagctgggtttggtggtgtgtgcctgtagtcccagctacccaggaggctgaagcaagagaatcgcttgaatctgggaggcggaggttgcagtctttagcatgggtgacagagtgagattctgtcttagaaacaacaacaacaacaacaaaaaccaacaacaagcacaaaccaataatagaaactttaaatgattctgagccttgagaggaatgtgattatgcaacctgggaaattcacctgcccatgaatagtatctctgtaattaataacaaagtcttacaggacagtccttgccatcaccatatcataaacgtatattgcttcttttagttcataggaacagggtctcctgctgtgtcatagctgtaggatttagcctaaatgctcagtgagtttgatgctcccttgagcaagcccgcttatttaagaaagtagtttttggatattcatggtttattgctgacagttaacgttctcaaaatagtgagagtcctaaagtcaaaggggaatttattaacaattttatttctgagaggatatgacaacaacaaagacattaataaaaaacaccagcgagctttctggcaatatgtattaaaattttcaaaaacacttatactctcgaatccagcagttattatttcgggaaattgctctaagaatattatctttttatacaaagcattttctgaagagaaktattcaggaaattttcatttatgaacagaaaaagtccaacattatggaaatagtgatataaaatacagcatatatagttctttggtattttacagtcatgtaatcatggagagaaatacttcagataaattaacataataaaccacaatacaaaaaagtatatttacaatagaaaaaaagtttaaaagtgtgttagcaatacaaataaacaaatacaagaaggatctatcacaacaatgctacagtgatgagccttcagataattttcattatttttcttgatacttctatatgttcaaaactttcattaatgagcctgtaataccagcactttgggaggccgagatgggctgatcgcttgagctcagtagttcaagaccaagctaggcaacatggcgagactccatctttacaaataatacatacatacataagtaactaagtaagtaaattagccaggcatagtggtatgttcctgtacttccagctacttggagggctaaggcaggaggattgcttgagcccaggaggtcaaggctgcagtgagccatgtttatacccctgcaatccagcttgagtgacagagtgagaccctatttcaaaaaacaaaatttcactgatgacaataaatattaccttgacatcaaaaaaaaaaaaaaaatccagtgcctggatgatcacccagtagcatctaaaagtgcatttgaatatatatccaggttctgatgccagcattgatgcttgttatgtgacaaaaagaaatcacctaactgctttgggcttccatttcttcaaagtaaaatgaagtggttaaacaggattactccccagatgtctccccaaactttacactggtgtaataattgtttgcaaggatcattgggtgattatgtctaaaagcctgcagttattagtcctcatatcaggaatgtgctatccccattcattttattgtagaacctggtttgctgtgggatagttgaaatwtgaagaattcacttggtcagtgtgtttcacggccttgctactttttctgcttggatggactcacttctctatatgattttctctttaaatcagaagtatttgacctgaagcagtaactcctctattcatataatagtgatattctgatacatatgtgaatattataaaaataagtagaatgataatattattactaatattattgtggcagtaataatattatcattcacatgtgatcaatagtaaaagcacacacagcaacccctcaggatttcatcctcaggccattgactcccatcacctttactgatatttagcttagctttacaatcctcccctttgaaaaattcatattttaaccttgcctcccataaagacacacattttttcagatatagaatttgcaaggctgagacatatctttttagaatgaacccaatataaacacaaagcaacataggagaaaagtactagttacatgcccatggcaagaaaatatgcctgaaatggttctgtttattttgttgttgttgtttctgcttggaatttcagcagttatttggcaaagtgattagctagctgggaaggaagaaagctcgtctccatcagccttttgtcagagcccgccttttggtcccrgagcccccatgaaagtgtgctgtagaccaggaccactgttgccctgaatgcatgagtatgcagcctttttatcgtaggcttgtcatctcctgagttctgcaatagatgccatgtgaaatccagtatatactcagtctaacacatagctgctgcataagaaaatttctttccatgcttaagcaatttctgcatagagcttaattcatagaaatcacttattcattcaaaaagcattcactgagttcctagtaggggccacatattacgctaaagtagatacaaggataaaccaaatgtagatctgtcctttaaagagtataacatgtagggaacaactacactctacatggcaatagaaagtcacaagtgggtgagaaccacaggagagaaacagtcagagggtgatgacagccagaactggtatgatgtgaaaggtcaatgacatcagaaacggcctcagggattttatagcctggctccttcaatttcagttcttggtataggccagcttttcaggactgttgattgtccctcttctttgtgtgaaattcctagtgsacagagcttctgcagtgcctcttaggtactttgaaaatcccaacgataaacatctggacccaacacagaagcctccaggaagctgtcttgttggcagtcacctacgagcaggcgataaacacaacacattaaatagtatgtaatgctccagggattgcagtcctctgcctcctaatctctctgtcctttcctcttttattgacytgtcaggagcatgacasttgtgcacaaccattagcacacaagaaatgactttcctgtgggggtgatggggactggggaacctactctttgagatagaaagttaccctgatgcagaataattacagtccagcttagcctccttataagcgattaatcttacttttcctcttagcttctgtctgtttgtaacctgaggttgaccgaagttagttcttttagttggttcttgagaaaaccctttcagtctgtatttccaggaataaatcttaactctaatttaaaaaacaaaarggccctataaatagttacttcaaaccctttaatttatagctgcattctcaatgtcttcatcctcccaaaatcactcacctctacatttttgccctaagtacctaggttagcacaacttttcacaacttctctttaacatttctctgaataacgtgaaccttccttatttccttaaaatataaacttatatatgttcttcctaggagattttcaacttttctgttctccacttattactctattcactctgttctctatctgagctgtcactaattagtatctacttaaataaatatttgagcaatttaacattacagtttttttttttttttttcagcaagaagtgtgttcattatccattaaaagcctgggagagggactactaatgttacaccatcaatatctatttttagccacttcggttttggaagtgtctcttcttttggaagtgggagaccaagtggaggggaagaacatgaacaagggattgaagccattgagaaagtcatttattcattcgatagatatcttctgagcactgcgctaggacctaaggacagaataatgaaggcagagtttatccttccactagcacagcagtcaaaaccaataggaattaagattrtcagaagtgacaaaactgtacatagacctgttcacataactaacaagggaaacgatggaggtgatrtggaagtctgaacgtggtgcaggaataactcagccaacatccccctcctttgggaaatttagatagatgtaggtagattgagaagtgatataacagtcatgtggcatcattgagagagtcagttttctataatgacaaagacatggaaagagagatgtttagtacatgtacagcagaaggagttgattcacaacgcaatggaaacagaagtcaagaagacagtgaagtggatgaagcaaggagaaatcataaaaacaagcacactgggactgtcggacctcaggggagagtgacgtggatggtaaaccaagtttggggccagagaaaagtgaaagcttgtgctgttcttgttggtagtcatgggcaggctgtagcagggttattattaaaactctgatcccccaagtccaactgaaggggctccagtcactaccccatcatctcagtggtgagatgtagtcaaggcatctaacctctctgcctcagtttcctcatatgtaaaatagagacaatcattataaagtgtttagcagaatgccagatccacagtaaatatcagtaaaaggaaatttrtaaatttgtaaattgttagggaatggggtgagaccctcaagattctaatcttcaagggaaagaggatgctaaggaaagtcagaggaagcccgagaatcctaagagaggatgatacaagcaaattaattaaggaataagatcaaagaatattgggaaatgtttaatccacttggtgtgggaaaaggacttttwtgtttgtttgtttttgagacggagtcttgctctgtcgcccaggctggactgcagtggtgcgttctcggctcactgcaagctccgtctccctggttcaagcgattctcctgcctcagcctcccgagtagctgggattacaggcgccagccacaacgcccacgcccagctaattttttttttttttttttttgtagtagagacggggtttcaccatgttggccagattggtcttgatctcctgacttcatgtgatccgcccgcctcggcctcccgaagtgctgggattacaggcgtgagccactgagcccggccgaaaaggactcttttttttttttttttacacagagtctcgctctgttgcccaggctggagtgcagtggcgccatctcggctcactgcaagctccgcctcccgggttcacgccattctcctgcctcagcctccagagtagctsggactacaggcgcccgccaccacacccggctaatttatttatttttttctttttttcttttttgtatttttartagagacggggtttcaccgtgttagccaggatggtctccgtctcctgacctcatgatccgcctccctcagccttccaaagtactgggattacaggcgtgagccaccgcgcccgaccatgaaaaggactctttttaacctcttctccatgtctaatctgagtttcaacctttttattcttattctgttataagtacttctcccattcaagagcatataaaactagaattactttgggatgagtgtgagtgggggagagagaaggttgggagatcactagttgtgtttgctggtactgaatcctaccctaatacttccgaaatgaacctcattggataactcaactcttcattatgtttttgctaatcttttaggagcctttttgcaacccaccgtctccctaccctcgttgggtctttttttttttcttcttcagtcagggttttgctctgtaacccagtggggaaagtggcatgatgatrgctcactgcagccycaaattcctggactcaagctattttcccgccttaccttcctgagcagctgggactataggcgcatgccatcatgcgtggctaatttctaaaaaatatatatttttgtagagacatctctctatgttgcatttctggtcttgaactcctaggcgcaagcaatcctcccacctcagcctcccagagtgctggggattgcaggctgtttaatagaagttatcaacatatggagtcatttatgtctattgaaatatgaacagccaattcccttcacttgtcccatttctaattcagacactaattctgtttcagtttaacttggatcaatggacttatctttgcttctgttcagttatctgtttcaacaacaataagattctttatctatatggcatagtgggtgaaaggacacactaaccttacctactgctccttttatgtcagaaaatccattttctaatcactttttcttggacccaagtgagtctgttttttcccctacattttgtaatttgtcacatttacattttaggtgggttgttctaatcgacttttcttataaaagggtagtggttctagatcaatcgccatcaatcatgctaccaagcaatggtgaagtaccctttttaaaatattttatttagaagaatttcttatttcagatacaacagatgatacaagttgaatctagtagggtttagtaagagacaataaacatattaaacaaagccttacgtattttttaaggtgaaaaaaatcccccaagatagagtccgtgcttagaaactacccctgttaaatacttaatatataacatttgtaatgttcaaataccgaaagaaaaaaatgtacttgttcagagtctattcttgagtcaacctaccttctcagctctactgaccccaaacaaggtaaacaagctgatttaagttacaactaacttaaaaattatacatctaactcttttgtaaataactttagggctggtgctcaaaataattggaactagctatgaaaagaaagctagaaatgagaatgaggaaaattggtagtaagtgtctatagagaagtgtggaccatctgcaattcctatatttaaacagggagaagagggagatggggactcactctctccctcacaaccacatgactaaactggcccagccaatatctcatcaggtgtctccaccactttacaaagccactgggaatttatcaagggataaatacaaaactggtgtagggagaggggaatgggaagttacttccaaagactctgaccctgagttcttggcgtttattcttttttttgagacagtctcactctgtcgcccaggctagagtgcagtggcgcgatatcaactcactgcaacctctacccctgggttccagtgattctccagcctcagcctcctgattagctgggattacagacacccgccatgacaccctgctaatttttgtaattttagtagagacagggtttcaacatattggtcaggctggtctcgaactcctgacctcaggtgatccacccaccttggtctytcaaagtgctgggattacaggtgtgagccacygtgcccggcccttggcctttattcyttattttccctgatattaatccctaatgaaatgcatttagtacacattcatctttttaaaatgtgcagtttttgtcacagaagtagtgtaaaggacaccagaatggttggaagacgatttttgtggtcttctacaagtcctgttttggtgactctgagcaagtcttaaccttgcctacatttcctcacatttagggcaagtgtactcttcagggtcaactgcaatatctgtgggagtgctttgtgttttgtagcatgcatcttactagtgcttttgttgttgtttgcgttgtcgtgygggttccccacctcccccataacactgtaaagaaatgctgagactaagtggtagggagtggcagccatctggtgaggatggaaagttaatatctttatttatgtaataaacctccctttagaattctgttactgtcaaatttctcctggaattctaatagtattttcgctatgtgttttgaccttttgctattgggaagacacaagtttatgaatgacaaatgggtaggggaatttaggctgcacagttaagtaggaagaatgaagtctttgctagagttagaatccagtttgaccttgaacaagttactcaatgactaagctccatttgcaaaatcgttttgttaaagggattagaggtaacatatctacatatgtacatgtgtacagtggtatggagaatggactggatgaatgcgtgctgttaccaatgtgataattactattctttttaaaaatagagtattttatgcatacacaatacttattcaattcaatttgccttagtgcacagtgatggaattttagaactggaattgacttcagaaataatctggtaaacgaaatcttttcgaggctcttcattttatggttgaggaaactaacatcctgagagctaaaagtcatcgttttcctttaaaatatctaaataatcccagatgttggatcagaactccaaagtcataatcagggcttttcctatttctatagtatttctaatactataacatgctattgctcagtcttttattctctaattccatcctggtttctagaccaaatatacctaattgtattctaacccacaagtacctcatcaatgagaagtctgacctatggtttatgatttccgcagacttaaatcaaccctgggcttctatccttatactagttttattttatgttttttgtttgtctttagagaaatgatcgtgttctgtcatccaggctggagtgcagggacataatcacagctcactgcagcctcaaactcctgggctccattgatcttcctgcttcaacctgctgagtagctaggacyacaggcacgcaccatcaggcccaactacatttttaaatttttttctagagacgatgtctcgccatgtttcccaagctggtcttgaaccctggcctcaagcaatcctcccacctcagcttccctaagtaccaggattacaggcataagccactgagcccagccccacccttacatgttttctcttggcatcctgatccctggacacaaccccattgagatacccttccatttaatacttttcttagtcatttaccaaatgtgtttayagtaatatattcccatatatttgtggcagagtacagcactcatataaattttgatgaacacagacatgctgtcccatacttgtaggtaaaacaatcatgtgaaattaaaataaatattttgtttagatagatcttgactatcatacacttattctaacaatattgcccattcctcaaaacattctgggaactccttgaaataaaactgactatggtaagaagagtttttctgggagttgggaaactgattccattagaaggcagatggtgatagtctcacagcacactctctcccatgcggtctctattctacaggcatgcagatatttccaaaagcatcccttccctccagggtcctgaagaccctacctctggttctgccttggactgctctcagtgatattccctttttttttttttttttggacggagtctcactctgccgccaggctggagggcagtggcaccatcttggctcactgcaacctccgcctcccaggttcaagtgattctcctgcctcagcctcccaagtagctgggactacaggcacgtgccaccacgcctagctaatttttgtgtgtgtgtgtgttttttttagtagaggtggggtttcaccatgttggccgggatggtctcgaactattaaccttgtgatctgcccacctcggcctcccaaagtgctgggattacaggcgtgagccactgtgcccggccgatattcctgtttttatggttgcaattgtatgctatggcaccggtactatgtgggaagaatgatgctaggtactctactggtatggcctcatttgtcgatttgaggattattggtttatttatgcaaagcacataggatcataggattgctctctaggagaatggagtaattaataccatgaagactcatagacaatgcttcctcccctagaaactcattatttttcgaattttggcactgatctttcctgcctacttcctggcttttactaccttgtgaaaaagccccaagtgttagaagcagcttccccagyttactgccatcccttctaaggtccctggacaccactgcttgtctcctaccttagaaagtgcctacttggccaggcacgctggctcacgcctgtaatcctagaactttgggaggctgaggcaggaggatcacgaggtcaagagatcgagaccatcctggccaacatggtgaaaccccarctctactaaaaatacaaaaattagctgggtgtggtggggcatgcctgtagtctcagctacttgggaggctgaggtaggagattcacttgaagccgggaggtggaggttgcagtgacctgagatcacgccactgcactccagcctggtgacagagagagactctgtctcaaaaaaaaaaaaaaaaaaaaaaaaagtgcctactcataccctcctcctatttattctgatttctgtgcatgtattctttttgtttgtttgtttttcagagacaaggtcttgctctgtcacctaggctggagtgcagtggcacagtggcatgaccatagctcactacagcctcaaactactcctgggctcaaaatgatccccctgcctcacctaccaagtagctgagactacaggcaaatgccaccatgcctagcctgtgcctgttttcttaaggcagaaatgatctaaaagtgtggcagagggaaaagaagatgggacttagagcttaaataaatctagatgaaaatgttggttctatcactcacaggttctgtgatgttagggaagttaagttatttgcaataaaaattattaatattgtagaacatgtattgatcctatgtatcaggcttgaattaggtgctttaagtgggttgtctcaattaattcatcactctgattttcaattttctgttctaagaaatgagatcaaatatgcctatcttgccgaagagtagtaaaaattagacaggtagctgcctctggatcctgcagggtagagaaagtattacatatctgcatgtgtggatgtgaaggacacacagatacataaggtaaatgagaatttattataaaggtgtatttgacaaaaattggggaaaaaaggaaaattggagaagatatctttctgtgagattaaagacaaataggggaaaaaagggaccaatgacaagaattagagcaaggtatgtaawgaattccagagctggctctaagagatagagcagctggtcatatrtgaaagggatgattcattcttcaggggctatccctcgtgatcctatttccttgcacaagctatcagttaatttattgattcacctcctttatgtgctcataggcatcaagaatacaatggatcacatacaattacagaaaagtttcatttcaggaggtcaaacaggaagtttctttctgacttatattgaagtactcatgatgacaatggagaaaaatgaacataatcttttatgggtggggaccatgtgatctcttttctttcaagctccagagggtttataagacatttccatgttcaatttgattccggaaattatatgttgggtagaacagactcttttyggcaactcatgagaattgccaatgatcccagcatttgctactcttgatagtaattcccttcatttcctccatttttatacatgacctgcagtaaatattgacagttactttgctggaaagaataacacagagacagcttttcttaagctccaaactgaatttcgtggttaattgattggccagctggccctgccgtctcttgacctctacaagagccagcaagattgatggtttcagcagcctttcatggtgcactaaagcattcagatctatcttttgttatttgggaaacactaagttcttatgtagcacattatttacatggactcaagggctgacgagctgggaggcagcaaatgcccaaatggaagacaatgtatgtagatcaaagaagccgatgagacagagagttcataaaatgtgaatacaattccaggggagaattgatgattatggaagcagaaagccaattgagttaaatattcattccagcaacaagtctgatcgtctcactgggacctgtgcctttccgaagtttcctcakcttttcaaggtctacacaaggaaagaacaaagccatcaaggaggctctcattctggaaagccggctgcaagatggcatgaaccagaggtcagcggccaccactgagagttcatcgtattcgcctctgtaaagaataagcctcaagcagtggttctgcaggagcggttcagcatcatcaataccaatgagccctaatgaatgtgacaattcagaatgattgggccttttcctccaaaacgtttttctcctcaaaagtaaaacaggcttgaaactcatgtcttatatatgctgtttagattttcatatattaatgtcacgaatcagatgataggaaggtatattaacaagtgagacattgggatatggccccttgttcaagagcatcaaagcattaaatatgttgttttaaaaatacctttggcatagttttaccacctatttctcaattgccatcaaaattttaacttttaatgacttttggaagtaggttagatggggtggtgggagaggaatagaggatacagaaagataaaaactaaatccaaaaatagtattgaatgagaattactaataagaattattaattgagtgtcttctcataaaaatagtaatatctgttctttggtctctcacaatacatagtttaactccatatataatttaatgaatgcaatgtgtcactttggttataggtttgcatcttggaaacgatgttagtagaaacaagtcagtttccctctgttcctttttgcttagctttctgggctatcttcaccaatgccacagtccatctgtaacagaatgcattggagatttgaaaaatcacgacagataataaatctctatatacttctcatcctctggaacaattgagacattgaaattgcctgatctttttgagtgagtgttgccactttgacccaggcaaatgagaaataaaacaacaataccaaccagcagtttcaagtatccttctgctgcataataactcagcagtaggctttgctaatggtgtttatgagctgccaggctagaattggcccttaagcagggaggcatttgcccagtgggcttcttccatgtgggggggcctttttgcagcctgggggcccttttaggtgattctcagccggagcggtctcttcaggccaaagacttttgcaatgagctaactatgttcaattattgctttcagatccaccctacattcaaatgttttgggacaccaatgtaataccataaaaatgactgtgtaggacacgcctatgctaatgtcatgactggtttgttttacgtattatttatttatttgatactgttaataaaaagcaaacaagccaaaaagaaatactccccaacgtttaatagagatcattgtatcctaaaatcttatagcacattagagtgcaatgaagctcaatgtaacaagcatcaacaatcaactacgaaatgagtatggaaatagagtatatccaaggaagacagaagtgtagaccacatgatgacagcgggataaagacaaaggagaaggtaatcgagagccaagggttaaaccattcaaattgtcctttggcattaaaatgatccaagatgtttcatgagttcaggttaaaaaaggaaatcagtaaaccccaatatactttaagtttcatttgacgcccacaagctgaaactacctctttgtggtgtgtgtctttacatcagcaaagagtataattgaatttggttattatctccagtgctacctgtttggacctgctatttcaccttcctgaaaactgttgcattgagttctactggggaaaattcttaagataacatctgtttactaagaagggggtgtgcttacctgctctaaggtattgaaatacattgtaaatctatacctaattcatataaacataatttcaaggaaaaacaaaaacataagagacagaccctggcggagtgccaaagaatttgtcagggtcccagtccctgtaccttatgggagaattaaattcattaaactgggccagatgtggtggctcacactggtaatctcagcactttgggaggctgaggcaggtggatcacctgaggtcaggagcttgagaccagcctggccaacatggtgaaaccccatctctactaaaaataaaaaaaattagtcargcttggtggtaggtgcctgtaatcccagctagtcaggaggctgaggcaggagagtcgcttgaacctgggaggcagaggttgcagtgagccgagatcgtaccactgcactctagcctgggcgacagaatgagactcagtctccaaaaaataaataaataaattcattaaactgaacaaattgagcccaatttatttgtcatagttcaaagaaaaggagagagtagagtaaaggggcttagtgcaaatgtctggtcagatactcaaaggtttagagcctcttaacccttatatttctttacataatttattctcattattttttgtttgttttttgagacagagccctgctctgtcatcagtctggagtacagtggcgcgatctcagctcactgcaatccctgcctcctgggttcaagtgattcccctgcctcagcctcccgagtagctgggactacaggcatgcatcaccatgcccagctaattttttctattttggcagrgatagggtttcaccaggttggccaggatggtctcaatctcctgaccttgtgatgtacccrccttggcctcccaaagcgctgggattacaggtgtgagccaccacgcccagcccattcttgtttcttggtaaaggaaaatccaactatatatatcttctttaggatcacytaaagacccatacagatctgtcaaatagacatccaatattttggtaggctttgaaaggaggtgcaaaaggatgagaaggaatttagggagatcattatctgaatcattgaacaaatgctccttaagcacctggtgaagagaggctactgagaagcagagcacgtggtcccagcctacgaggtgacaaagtaaaatggcagaagcaatttgtaatgatctcacctatatgtggaatctaaaaaaaagtcagcctcatggaaacagtagaaaggtgattaccaggtctgggggctaggagagagatagggaaggggaaatgctgtcaaaggatccaaagtttcagttagacagaaaaaataaacttcagtgatctattgcacagcatggtgaccacagttaaaaataatgtatggtacatctccaaattgcttaaaaaaaaaaaaaaggtttcaaatgttgtcaccacagaaaaacaaaaacaaaaacaaaaaaaacaaaaaaaacgaggcaaggtgatggagwtgttaattagcttgatttaaccttcctacaatgtatatgtgttagtccgtttttgcgttgctgtaaagaagtatctgaggctaggtaatttgtaaagaaaagtggcttattttggctcatggttctgtagactataaaggtagcgtggtgctagcatctgcttttggtgagggctcagaaagcttccartcatggcagaaggcaaagggggagcccacatatcagatggtgagagggagcaagagttgagggggaggtgccacrctcttttaaacaaccagatctcatatgaactcagagcaagaactcactcattatcgtgagaacaacaccacgctattcacaagggatccacccccatgaccaaaacacctcccactgggccccacttccaacactgcgggttacatttcaacatgagatttaaaaccatgtcagtatacatacatacattaaaatatgcatcacattgtgccctatacacatataaattattgtttgtcaattaaagaaagaaataattttaaaataaataggccaggcgcagtggctgatgcctataatccaagcactttgggaggccaaggcaggcagattccttgagcccaggagttcaagagcagcctgggcaacatgatgaaayctcatctctaaaaaaatacaaaaattagctgggtatgtggggggtgcacaggtagtcccagctactcaagaggctgaggtggggggattgcttgagcctggcaggcggaggttgcagtgagattgcaccactgcacaccagcctgggtaacccattgagaacctgtcttaataaataaataaataaataaacaaacaaataaaggttgtgttagaacaaaaaagaaaaagagtgacaatgcaagccacatagttgaagttgacattaactagcatgtgccaacgagtgacaaaggaaacaagtgcaaagcaagaaaagttagccattatcatggtccatagataatactctcaaccccggctcttgagtgaagcagtattgtgcagtggttacatttatggacctaatggtcaaactgcatgagttcaaatcccagctttacagctawtggttgcattatcttgggcaagtcatttaacatctctgccttaattgattcacctctratatagagctgataggagtctgaaatagctgctataaggactaaatacattaatatatagatagcattcataacagtgttttgtggactttccgaaggtgctgggccttccagttgccttaaagaatggattggattagggtggaggagatgaaaaaaggcatcacagtacatcaagtgmatggtgccagtgtaagtagaatacaggaataaggaaatgcccagcttgttggggggttagtatgaagacctctaactgggactgaaagttctagcaacagtaaaataccctggcctccaactactaagtaccctgaatactaagatgagtttatttttcattctatagacaatttccatctctttctttcaaaacaaacaaatgatgacrctgtatgagtaacagaagatgactgggaacagaaccgtgaacagaattaagcacctgcaatcaaataaaattcacagaaaacttaatttaccacattagtgatatgcataatcgttgttgtrctggtaaccagctcttcaggaaaaaaaaaagaaaattcctgatttgttaaaatactgtcactatggcccactgaaactatcaaaatgaggcatataacaggaaattgggaggagagttatacaatcagctcttgctagaaaatgatgatcattgacattacccttatggaaccaatccaaatttgggsgttgttttctttctttctacttttgtgtgtgtgtgtgtgtgtgtgtgtgttctctggtatctgtaaataacatccatatcagtttctccatccattctttgcacatcactggtaatgcctgagatcaaatctgccatgcttttccgggcagatccaggctgggatctcagtatccctgcttccctgaagctgtccaacctcactcccttcattgctctgctgtgattaggaaggagccattccaaggactatggggtgctctgtgggataagcccagtccttcttccatacaggaggaacaggggacgggtgctgacaagaggaaatgcatggagcagagagagggaacaggcagatggactcaaggtccccagactctttcgagtgttgartcagaaggactggagctgtgggggaagagggtgggaacagggtagtggaataacatgcagacagatgggctgaactgaaggtccagaggcactcccagccgtcaaccagcagttcttacaccaggttgatgttagggaacaaccccagctttaaaacttatttataccaaagtgccaaatgactcatttgagacaaggctttgatctctggggacagggcgttagacagcatgaggcttaggttgccaggtgtcttcccacagttcctgtcttgtgtatgttacacactcaattcatgtcaggatgacactacattggcatgatccaagggaacccataactgacatgaatatgtgtgtgtgtgttgattggggagatgggaaagagaacatttcttccagattttctagttcttatagttcataatcttaatcctcatctccacttctctgccacttctctggctaaatccaaagcacagcctggctagagaggacttctcttccttgggggttctagtctattctctgagttgtgacaaacatttccattccctgtaattacccacttgccttgtctctgaagaggcattcacagaataaaccaaaagaattgtagtgttaggaagatgtcaaatcatttgacctctactccatctccggcttttccttctccccccatgaaagttatgcatttagttgcctcttgttcattagtctggacttagagcaaagtgactacttcaacttcttgtgctcaacatatgccacagttgcttacatgtgataagtccatttgtcacttgataagcctttgctagaatttccttctctccatctccaaccttataatgatcttgaaggcaatgtcggaggctaggtaartcttctttgtgttccccacttgagcataggtgagctgtcatgtcaatttccttacactactgagaagaggggatgtgggtgggcagggacccccagaaacaactttacccctttcacagtttccatcactgcctccaatgtccaccgacgttagaaagtttgggcagaagtggccaggtgcggtggctcacgcctgtaatcccagcactttggggggccgaggcgggcagatcacaagctcaggagatcgagaccatcctggctaacatggtgaaaacccgtctctactaaaaatacaaaaattagccrggcgtggtgtcaggcgcctgcagtcccagctactagggaggctgaggcagaagaatggcatgaacccaggaggcggagcttgcagtgagccaagatcgcaccactgcactccagcctgggcgacagagcaagactccgtatcaaaaaaaaaaaaaagaaagtttgggcaaaacctagagtttcagggaaagtcatttgaggtttggtttaggcaggaaatagaacaaaaccagtgtactaaggagaatacagtggaaataagagggaaaggaatgaagaaactggtaggctactaaaatgcccaggtacaaactactgaacatccacctttatgctgtcagtgggcagaaaaagaaatagacaatgacaagatacattttgaattagtgtgatttaaggactggctgatgtgcacaaaacatgagagaagggagtcaactttgacagagatttcaagagcagatcactgatgaaatgtgataacattcagaaaatagagaagttgacatgggctttgatgaaaacacaatgagttcagtttgaagcattttgaagtcaaggtgattttgtgaaatacaaacgatgctgtccagcaggcatagaatctatctggagycatttgtacaatatacctatgccttttttttttctttctcctactgtagacttagataggaactcacttttgtcttttttctgctaggccaataaatacgttctcagcttagaaaaggggctttttggtttgcctatttctgtttctttttacagaagttaacacatttatttgtgacctattaaaatcatgaagtattaccactgggttttatgttttaatggaaacatttcatgtttagagaataatgatgcttaaaatttatatgaattaaaattttagcctgtaaaaagagcctggaaatatcttcataccatcatctatccttccacttaaatattaatcacaaagaagatcaggcgtagtgaacatacaccacgcaacctcccattcagagaattcttgtgcaaagaaggattccaaagggtttcagaaatactaaacttcttgaaattgaaattgaaattgaaatccttcttggcttctctacctgttacttcctctgcagtgctcagtatagtgtctgctctccctcctttctttttctttttttttgagacagattttcactcttgttgcctaggctggagtgtaatggygcaatcttggctcaccgcaacctctgcctcttgggttcaagcgatactcctgcctcagcctcccaaggagctgggattatagtaccacgcccagctaattttgtcttttcagtagagatggggtttctccatgttggtcaggctggtctccaactcctgacctctggtgatcctccctcctcggcctcccaaagtgctgggattactggcgtgagccacacacccggtctgctctccctcctttcttcacttttctgcttcctctctcatattaataataagcttctatctttccttaattgtttacatatctgtctgtcctctttctccaccccacgaactcctcaaaggcagagtccctgtcttttttatttcatatccctaatggtagctgcaaagcagacactcaagaaggaaggaaggaagtaggtgggagaaaggaagaagaaaggaaaatgaaattaactactagtttgtttccctgtttcattgagaacacacgtattaaccaaacaagtaaacaattgtcagaatattgcattttaaactcctgagagaagttgctgcttctgtggcatttctatctaattaagtttccccttaaagttgtaatcttttctttcaaatctcataatacgtcttatttaggtgatcataccaattatatctttcccactcaaacccctaaagttatccttgaataaatgagccttgcaaattatatttccccaatttgcacttatttctttcttttttttcttttttctttgagacagagtttcactcttattgcccaggttggagtgcaatggagtgatctcagctcactgcaacctccgcctcctgggtttaagcaattctcctgcctcagcctccyragtagctgggattacaggcgctccccccctccccatgcctggctaattttttatatttttagtagacagggttttgccgtgttggccaggctggtctcaaactcctgacctcaagggatctgcccacttcggcctcccaaagtgctgggattacagatgtgagccaccgcacccagcctcagaatttcttactgaataatccttttatagtttgttataactaacwcaaaacagtagtgggagttcttattcagatagctaamaaattccaggcacctcctgtactataagtgtccctcatagcacaaaggggaaagctgccctttaagaatccataaatgcaatgaaactctacttacgccacccaggttgttaggacacaggaatattaatctggagaagcctttgataatagaatatagtcaaagttgacattgtgctagaatatttgaattttttattttccagaaattattttcactctttgctacatttactgtttgacctcaaaagaatgtaaaagcaagtttttaaatacaccattatttcctcaagaggctacagaattgctggatttttttttttttttggaatggagtcttgctctgccacccaggctggagtgcagtggcaygaccttggcacactgcaacctccacctcctgggttcaagcagttctcttacctcagcctcctgagtagctgagattacaggtgtgtgctcccatgcctggctaatttttgtatttttagtagaggtggggtttcgccatgttggccaggctggtctcaaattcctgacctcaagcaattcacttgccacagcctcccaaagtgctgggactacatgtgtgagccactgtgcccaacccagaattgctggaacttaatgccaactctcaattgtctttccttctgctagatctagttaatagcaggtgtctgatacatgttactgaagtgaatatgaaaaatccagagtaagcaaataaatcatatttttttaattaaaaacatataaagtacatttttgtcaaatgaacctaattggcaaagcaaaatctcatcttttaaatttctgagtttccactattgataaaaaaaaaaaaaataacgtaaaacagtgttggattttcaaactcaaaagaaagaaaaaaaccacaaaaaacaaaaaaagcagaagttgggtaaaaacgagttctgactaaaagctgcaatactgyctcaaatgtgcccrtgaccccacctattgctcaatttctacaccatgagggtaaagggaaacgaaatgcaacttggattcacttgacttcttaagtcttacagagagagaaactgatcagaaaagatacatttttggaggttggtttttttttttaattcttgcttgtaaggcagggcttggtgactcctggtctcctccaatagcctaattttcctcccaaaagtaagcttttgattccactagggtgggcaagtatctttgtactctgccatttcagagataagagccaactgattttagaaatccaagagcaaatgaaatgtgcaacattttactcttggattgcttgagacygcatctgtatgcctattccctggagtgcagactgtcttgtgagcatttggtgccactgaactctgaaaatcagggcatgcagcatctgctggggaacacaatctggtttctgtggatcagaagcatttctctacacgttagagtcttaaggatttttaaagagagcaggtctactcaggcaactcgttaccgtccctttcaaccggagtcagaactaagaatgctcagcagatggttgtggagtgaggtaaatttacatgcagccttcagtcattagtgacagatctattttaaagggacgaggttgtgcaacaagggtacaaaggcagctcatggttctaattgttgggctccattagaaggggtctttctggagactgtggtttcttagagcaccgcagtctacccctgaatgaaaggcatcctgctggctaattaacttgcagcactttcttctctattgkgccttgattttttgttttgtttggttttaatctcagaccttgtttctagtaggactgatggagtcttccattatttcgccyaaatattttatgaagaacaragtttccaatcactcactcactctgatttcattacttttagcatacttttcgttcttataatctgcaataaagaggaagactattaagattcaagcttgtttgagcaagtacactgccagagcaaaatcagaggaattcatggaagactgggaaggtgcaagtaatctttctcttagaattgtgatggtaacatatgaaataaaatgtgggagcaaatgaagccattgaaaagagaggccattatacttctgaccacttgggaaataccccccaaaatagctgaaaggtcccaagaggctgggcacagtggctcacatctgtaatcctagcactttgagaggccaaggcaggcagatcacttgagcccaggagtcagagaccagcttgggcaacatggcaaaaccccatctctacccaaacaaacaaacaaacaaacaaacaaactagccaggcatggtggcaactgcttgtagtctagctacagcttccatgaattgttcagtgatgctctcttaactccatgatctatggaacaggcaggcagaaatggagagacagtgggtggaggggaggagcctcaratggcacagaaatctgtagcatctagatcagagtgacacctcagagtttcgagtaacgacaggcacctggcccatggctgggattgttaccagtggtgaatctgtgcaggtctgcagcaacctcaattcttccctcyttaggataaaaacttcattgaggggcataaagcagaagagactgaagcaagttttagagagggagtgaaagtttattaaaaagctttagagcaggaatgaaaagaaagtaaaatacacttggaagagggccaagcagacatcttggaggtcaagcacagggatttgaccttctgacttgggggtgtatatgctggcctatttccagcacttcacatcccttttcccttgattcttcctttaggatgggctgccgcatgtgtggtggcctgctagtgcttgggaagtgagcatgcrcagtgtgtttactggcgttgtacacatgctcacctgaggcgttcttcgggtgaatgcccccagaaagtcatgtaccagttaaactctgccatttggcctcttagtgcatatgtgtgagccccctgcscaactcctgggaccttatcgggaagctgataatcaccagtttcagatttttcctatttataaaaagactgcctttccctggagctggctgcaaccaattattttagagagacagttaccaaccacctgttcatcacttgatggtggcctgacattcctggttagggcggggggcactgtcctgctctgctcatgtctgcctacctactgtagcaggaccacaggcagacttttcttaaggagactcccagctttcttcctggtgaaggacccagagtttgtgagcccaggactgcagataatcaaaaatattaaattatggaagctaaatatttaaaataataactcataatggctctccaaatgtctgtaaaagsatttcacttaacaatasctggcaaatattatgtcagtggaaaatacagccaagttttggctcatccaaaatgttgtcatcaccgccactttaatatttaagagattaatgtttcaaggctcttccagaacattgtatttggagtctgattgaaagactcctcggtcctccctcattattctttatgtgtgactttggatgctctcaatacacttaaattgtatgtccctgtggggaatggttctcaaagtgtagtatctggagcagcagtatcagcttcacctgggaacttgttaaaaacataaattcttgcagctggatgtggtggcacatgcctataatcccaatgggagaccaaggtaggaggatatcttgagcttaggagtttgagactagcctgagcaacatagtgagaccccatctctataaaaaataaacaaaattagctggacacagtggtgtatgcctgtagttctagctacaggggagtctgaggtaggaggattgcttgaacccaggagttcaaggctgcagtgaactgatatcgcgccactgcactccagtctgagtgacagaacgagactctgtctcaaaaaaaaaaaaactgggggccacacaacagacatactgaatcagaagcctgggggtgtagctcagcttgtattttaacaaggcctccatgcaattctgatgtgccctccagttttagaattgatgctctgtgcaaatgaacaggtactggggcataatgatatgcaggactgttcttgagccaggctttgtattcatgaagtgggtgatagttgattggcattgtttcagtactcagtagctatgaagcattctattggtatcattrgtattaaatatggagcagaagcataactcatctccctcatggccacatgaagaaagatcagtatgttagagctgaaggacacctaaagccccaaacaactgccagagaccaaaatcatttgtctcaagaaatgttaacaccctttttgtgttcaagttttattatttctttactaaaattgcccattcacccctttgttttatttttcacacctaaaaaagtagccaagtttgaaaaagaaagagtgcttgccaccctttctgtccttaaagtgaaggccttgtctatctcattctgatctctgcccatccatcaccattcagcactcctgttgtgacttcgccccatctccaatcttacrttttattttcttggtacttttggtcatggctgtgttgatggtttcagaagaatacatagtatattaaggggtaacgtttacaaatgttcttgagagaactaatttttcccccttcatctcaaggtgtcactgcttaattattacggttcctaaataatctctatgatgtggttaactatccctaccttgcagaaatcctggaagatgagacggacctagcatgttgtgtgagcaacatctcttagagataatcaatttgatatcagcacaattattgtggctactattgaaatttctcttagtttcttagattagtactattggaactaatcrtaaataaccaatttacaagaaaatgagtctcattatattatagcacgaagaggatatattcaaggagatacacctttgaatctattatttcratatgcttataaaaattactattttaataaatttcccagtcaatcctattgtgtagaaaaagatgcttcactgcttacatattttaagatgagactgggaacaagcagattaatttggttgtgagactgggagtttatgagcaaaatgttcttctgtgcaaacgaagtagaagcttcatttcccttcccttcagttaaccctatgttattggatacgtaccaggtactagagattctctccctgggtagtctggcttagaatggctccccaggctctagccatctgcatagctgctagaggaaaaagctgttttagttggctccaagaatgtctctgggaattataatgtattcatagaaatgagtgtggagtgcccacttgcacaatggaagatccacaataatacacctggatctgatagcaccttcctgaacttgggccacttccctctttgaggtttgtgaggccaaagggatatacacagaggctgcctttgtttgtgattacctgggaattagatggggtatcattcccccttatatccttttactatagcttgttcacttttgaaaaggtggaaaactagactaaattctgtattgaaaatgtcaagtcaaatatgctatataaccaagaaatatcagtatagaatatcatgtattctacacaaagctacattttcaatataatccccgtaattatttcactcatcaaagaaatgtatccagctgagacataaaaccttagtcaatacattaagaaaaaaagaaaaaaaaaamcatttttttcccagtcatggggaccagattgtgtctattattcatcagggcctagcacaatgttgagcacatgctcaaggtggccaataaatccttgtggaattgagttatatgggagtcaattattcggtcacagcactggattaggaggttgagttcttgatagatttactttcagctgacctgtgtgacatttggtatttggttttgcaactttgttttcagttttttccatgcaccaatactcctagaattttgcttttgcctcttttcttccctttcatcttttttttttttctgtagaaagcatacatccatatagaagacctctctcaatacattccagatctgagttgcagtgcagcacttagcttagcttgtgaaacactccraagacttgattaatatcatcctatggagagatgtccttaagtaacttagaatggatcctttatttttccagtaaataaactctaaaatatgaggatttccaaggtgaaaagaaagagtacgaacccaagaaatattttaaatgaatcttgttttccgtccctgtgttctgagtaacatctgtattcacccctgcctttccattgattggaaacctttagtattctttgtactctcacagtcctagtttctcagaactgtctgtcccagtctaggcagttgtttcattaaacaaatgttattaaacaaataattttgagtgtgtgtctggtggggaggggaggctggggggttaaattcatgtatttttaggcaagagtattaacaagaattgtttgaaatatttctgaaaccatagtgtcataatgaaaataaaaataaggtggagactggattgtaattaacacagagcttttccatccaagacagagcttaaaggcctctgtttgttgggtcactttaaaaacaaaccctactgccagggatttccaatggcaactttaccgtgcttacccaaatggaggtaattaacaacccttctgtgtgttaaattaggtatccacagaattgggaagcttcagatatttattgtaaaccagagcctcttttcttgttaatctcctaagacagcagactagtgactcgcacccattagaacaaatgaactaagaaactgaatgacaggttctgaggcccctaagaagaaaaaacagagtctggattagagctgcttaacagaccactcactggggcatgctccctccccacgcccatttcctatcccagaaaataacaaacttcagatgacccgccaaaaacgactaccttttatatttgtcgttgaattatttcttctttgtttaaaattaaataatgcaagtgatttttttgctttagaaaggaggattacctcttcctagacatccagttgaaaaaccaactggtatagaagggaaatgcatctcaaacagatacaatgacattcttataattgcctcatttgaaatggcagcatttccccgtgctaattrtcatccttcagctaatttggtacattaaaggagattgttattaaaaacaaaattaaatccattgccagcatctttattctctaccagaagaaaaattttaaataaatgcaaatacgccagttttgctcttaatgttgcctgaagttgaaaggatgaactttgacttgaaagataatgagttccccctgttggaggatytgaggtttgggttggataatcccagatgatgttggaatagacagaatttaaggttccttctaaccctgaaattctatggttataaaatctatccttttcttgaaagaagaaatattaaaggtgttttcaaggaaatggtagcataatgaaaaaggaaacacaaaaatgatttttttttccttaataagcagtcacctcacttggtaatagtttttcttcttaattgcttgtttgtttgtaacaaatgcggtggtgtaatcaagtggcttttacaataataaaacacttctctcaattaaactgtactgcaaggaattcaaagatgaacagaagtgttccttcttttaagatgctgatttataagcatccctttaaaatttacttctctttctgatgataaaagtaatacaygtttattgtagaacatttggaaactaccagggactataaataacccatagttgccccaccagagaatattcttaatatttttggcatatttcttccatatatctattcatattcacattcatactaatttgtcatattctaatttaaccctctctttaatgtttataatgtgattatactactttttaacacatgaattgtctccaaataaaagccaaagtgatccatttgttaattttttttaatcctacccagctgaaatggacaaagaggagcccatctcactcgggggaggggatcaaagagttatcctttctcttgatcaattctgtagcaatcagccatgataagaagcccaaattaccaaattaacaaaaagaattttatttagtggccatatataaaagctaaatggacagttggagacagacaacaaaaactaatataaaactaaaaatgtgaaaattcagcatttaatgaaaatgagagcttagaaaaactagcatccagatttattcagactgaatttctgccctgggaaattaatgaatcatccttcagttcccttttgtgtctgtgcatccagcctcattgtccttggtagtaaattatgtacaccccctgtttccaaatcttcaaatacggtatgcgtcataaagtcacaaaatgtgtaatttgggtcctgtatacaaattctagccagggaatggcttgtagtcatgctaaatattctttacaagttgtgtaacaaagacaaagaaaactacaaaaaaatacagagaaacataaaaaatttcccattccttctgtgattctgatgtatttccctttgattctttgcttctacattgaaatagacttagtgggtaatactaataattacagttaacagtgaccaggtgatatggtttgactaggtccccacccaaaatctcatcttgaactgtagctcccataattcgcacgtcatgggagggatcccgtcggaggtaattgaatcatgggggaaggtctttcctgtactgttcttgtgatagtcaataagtctcacgagatctggtggttttataaaggggagttcccctgcacatgctgtcttgcctgccaccatgtaagacgtgactttgttcctcttttgccttccaccatgattgtgaggcttccccagccatgtggaactgtgagtccattaaacctctttctttataaattactcagtcttgggtatgtctttgttgttgttgttgttttgagacagagtttcactcttgttgcccaggctgaagtgcagtggtgtgatctcggctcactgaaacctctgcctcccaggttgaagggattctcctgcctcaccctcccgagcagctgggattacaggcgctcgccaccacgcccagctaatttttatatttttagtagagatggggtttcgccaygttggccaggctggtctcgaaccctgacttcaggtgatccacccgcttcagcctcccaaagtgttgggattacaggagtgagccactgtgcccagcctgtttggttttgtttttgttattgtttgtttgtttggagtatgtctttattagcagtgtgagaacaaactaatacatcagaagttctgattttcatatcagcacagagaaaagtgaccttcccagtccagtctatcgtattctcaaattactttctctaacttgtgaaataagatcttcttggtgaactttatcagacatttctgaacagaattaccactctgtggtggcctgggtaaatgtaatatatttataataatttgaaaagattcctccaggacttttacaaagacagatgatattaaactgaacaaatagtgctaggtaagaagtaaattgttcaattttttcacagaagccctgtagattttagcaaaaccccccagacacaatgtcaaatttctcagcaggtttcttggttttagctcttccccttaagcagtagttaacagaatattagatgtkagtaaagttatttctttgttattctacctgggttgactaccagagaaaatccctgaacattttacaaattgctcaacagattttcatctaaaactagaaaagattggccagttatggtggctcacgcaggaacattgctttagcccaggagctgaaaaccagcctgggcaatagagtgggacccccatttctaaaaaataatatcttttaaaaaattaactgggcatgkcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaattagaaaggataggtgtgtktgggagggagactggttaaycagggtgcatgggattatgtagggcttgtctttcatttgagttcttctctgtctttttaaaatgactgattatatatattaggtcccaatggcttcattatcactattattttaattcataggttaaattttataaacatgaaaaataattgacaagcctagaatctcttttctgtctatattagaaattaaattatatttagtakttaagcaatacatgcatacatctcatgtaatccttactgtaattaaggatgaaattatgtaacataggaaaagcagatgtaagttctcattctccttttacacataaggaaattaattcagacttttagtaagttgcccagaatcacgcagctagtaagattcagaactaaaaatataatacctgtcttctaattcaaatgtttcacatccaagtgcccatatactaataatttttaactcttttgttggggttaaatgagataaaattgagtcttattgtatagaatttatcagaaatagcaaaatttcgcccaggcacggtggctcacgcctgtaatcccagaactttgggaggccgaggcaggtggatcatctgaggtcaggagttcgagaccagcctggccaacatggtgaaaacccgtctctgctaaaaatacaaaaattagctgggcatggtggcaggcacctgtaatcccagctacttgggaggctgaggcaggagaatcacttgaacctgggaggcgggggttgcagtgagccaagactgtgtcattgcactccagcctgggcgacagagagagattttgtatcaaaaaaaaaaaaaaaaaaggaaaatctctaaaatgatacctaaaatgataaacaatttaaatttagcataattatcattttttaacttacagattgacatatttctgcaagtgttttcagaggcattggggccacagaagtccaagtcaaggcaatttttggtactaaacagttgacttttctctggtccacatcaaagctgccactgtgcagagaactaacaygtgtaygtgactagtctagggctggaggaacatgcgaggggactgttggaaaggaaaaacttttgctcttcctctaggttcagtaaattagggactgtaaacaataataatgaaagattaataagaggcacacaattttattttattttattttatttacttatttttttgagacagagtttcrctcttgttgcccaagctggggtgcaatggcacgatctcggctcaccacaacctccccttcccgggttcaagtgattctcctgtctcagcctaccaagtagctgggattacagacatgcatgaccatgcccggctaattttgtagttttagtagagactgggtttctccatgttggtcagcctagtctcgaactcctgacctcaggtcatccactcacctcggcctcccaaagtactgggattacaggtgtragccactgtgcccggccccacaattttattaatatttatatgcaaaagagcttgtagaaaatcagtgaaaatcaaagaagtggttagactagggggtttataaacccttcttaaccaaggaaagagggtttgggcatcaatgagtggcgaattgtggagaagtgactagaaaatgtatgagagaaactaatggaaggtatattagttcattctcaagctgctataaggacatgcccaagactgggtaatttataaatgaaaaaggtttgactcacagttctgcagggcgtggaggcctcaggaaacttacaatcatggcagaaggagaagcaaacacatccttcttcacatggcggctgcaaggagaagtgctgagcaaaaaggggaaaagccccttataaaaccatcagatcctgtgagaactcactcactatcgtgagaactcacttactatcatgagaacagcatgagggtaacagcccccatcgttcaattacctccgaccaggtcccttccatgacacatggggattatggggactacaattcaagatgagatttgggtggggacacagccaaaccatatcagaaggtaaggcctattttagtaagttttgtttatgcaaactcatctcagtgttgactccctatctttataacatgggtcacttttttcttcctgatggtgtgggggagagggcacctatctcaaagagaaattttgctctgcttttagatgtacaagggaaagacagagaactgttcctgcatccattgattatcaattgccttcagctcaaaataatccttatgccaaagtagcatattttggggtggcatatttcaacctccttcatctctacccagctggaactgtccagggagttgcatacctcaaaagctgagttggtggctataaagacaagatttgggttagttcctgagaggtaagagacctgcaaagggaaagaacatagatcagaacgagaataaataagcagaaaagagcaaatctcagcacattcccactgatctcactaaaccaggctcctagtactggaaataggtcagtcaacttcaacaattgtatctcatttcaggaagcagcatgcaggtgggagtggggcacccctctgaagtttggcctttatgctatgtgaataatcacacacttaaagagaggcatttctatgaaaacaaaagaaaaacaaagattaacagttggagcagactctaaagccagtttttgagtccagaaggcagttagttggcaagatttctaaatgttggattcaaggctgggtgcggtagctgacatctataatcccaacattttgggaggctcaagtgggagaattgctcgaggccaggagttcaagataaacccgggcaacacagtgtractccatctctaataaagtcatccaaatgtagttgtatgcacctgtggtaccaactactcaggaggctgaggtggacggattgcttgagcccaggaggtctaggctgcagtgagccatgatcacaccactgccctccagcctgggcgacagagtgagatcctgtcttaaaaataaataaataaataaataaatgttggatgaagtgtctttagatggtggattgaggataacaggggcagtctcagtcacgtgcatttcccggagtttgaargaacatgttctggtgagcttcctgagtggtccaaactacggtagtgataattcctttgaagttaggttcagttgtccaacttcagcttccagggctccaagaaaagggcaattgtggttctcagtgatgccaagtcacaagggtgagagaagactggaaacattaattacaagatggcaggattcagtttataaaggggggaaatatctcaatgataatgaacattcacaagggtgggttatagttttccattaaaacataaaatttctttctacaatcacccccaatgtgatcaaaaacaatcaaagtatgtctgcttgtgtctggcaactgagtctagtctcattaaacttggccagattatttacataataagtgcagcaagaatagtaatttagcacgtaggcttttttgtgtttgctcttctggaacttttaataaggactctcagaatagacttttaaaagctcttgagagtagtaagccaagccaagaactagccattagactttatctgtaatacctatagattggggtgaatttcccttttcttgaggactctaaaacattctgagtttcccgggcctgccagaaagttaccttccttacccacctgtaaggctaggaacgctataaaccagatacgagtcttacttttccaagggagctttgtaagcgttggtgccatatagtcaaccttagttccttaaaactattgggttatatgtgattccacacacattattttcaaacatgacactgcagtcaaagccttagtaggacagccaatgtttccaattgtgttctgttccaaggagaatagattcttatggaacttaggcaaataactatattgccatgaaaattgaaatactcaataagcatttctgaattttggagagatcaggtaggggcaaaagataaatatttcatttttgtttatgaagacataatctattaaattattgtgaattacaggtagcttttagaaagggtttcctgacatccagaagatagaacattaaataaccagcaaggtttcaatcaaaaaggccataaaaattataattgttttttatcagttcattcagtcccatgtaattaattcttgttttgcttgatcttagattagtggatttatgaatccatcagcttctccattagttctggaaatccttactgtgtccagtgttataatcttgaagttatttaagcaatgtcagcagaagcctgtactccagagtacctgccaaggttttgttcatgaatctctaatatgctctttctttgctgaagatgaggcatgctggcctacagctgactgcgtgagccttcagaaaagcatcggcataaaacaataattatctgtgaatgacaatgacttaaaatggccatacctaaagatctgatgarwgttcattataagtcaattgataaagaaatttggtygtttctctgacatacaggattttaagataataatgtgataccaagacatctcatgaacagcaagggcaytgacagatttctaggaattttatatgatttctgaaaaatcaaaatcattatatccatacaaatataacccaggaatggttaaatatcttctctttatttgacagtgcttcccatgcaatttagcatattaaataagctcatctctctttttacaaactgagagaacaaatcctttgagagttttccaggggccctctgggaaattccagagtcaattcaaggtcaagaagacttcatttggaatttgatttagggaagttgtgaaaaacgtgaaaaggtttgaacaattgattaaatgggatcacagatcactataaaacaatacttagttatctatttaaccaaagtgacaataaaagattttcaagataaatatggaagataacataatcataaaaaattttaactctttcaatcttaagaaaacttggttttctgaaataatcaaagacataataagtgcaacataaagcacagaatatttattttctaggtgtatcactcaagaggtaaagaaaacatttcataatctcttaccaagaatagactactcggtatagtggctgaggcctgtaattccagtcctttaggaggctaaggtgggaggattgcttgaggccaggagttcaagaccagcctaggcaatatagtgagaccctgtctctctaagaacaaaaaatagattaataaaccaagaaaacttgctcattttaaaagtagttttgcatcaatacactactgtattagtccattcttgcattgctgtaaagaaatacctgagattgggtaatttacaaagaaaagaggttgactcrcagctctgyaggctatacaagaagcatagcagcttctgcttcttgggaggcatcgggaagcctccaatcatggcagaaggtgaaggtggagtaggcgtcttacatggcaggagcaggagcaacagagggtaaggggtcaggtgccacacaattttaaatgaccagatcttacgagaactcggtcactatcatgagtacagtaccaagagggatggtgctaaaacgttcttgagaaatctgcccccatgattacaatcacctcccaccagagcccacctccaacactggggattacatttcaacatgtgatttggtggggacacacatttaacccatatcaactactaagctcattctttaaaaccttataaatacacccattcagtcctagccagcgtggccacacaatgtaagattctctctctcttctgttctctctctctctctttcactgacctttacaactttctatatcaactcacatttttgtcctttattttcgtctttcttatttaaatgacctctaaactactctaggataaaagtcactgtcatttttctttaacaaaaacacatctcactctccttgtackctttgcctgcagagttttgtttcttcatcctattattactagtagttcatttacayatatttattagatttcttaacccttagtaacattaactttcagtgaaaatgaagaaataaacaatcataaactgtcagttacatacatgcattctgtgctacattagcacaggtataaatacattctctcataatttctagaggcatgtttcctaacagtacaacttctcagtgtggcaaaagagcaggtttattaacagatccaaatacctttagtctctgccaaattaagaagtcaaaagtagccgggcgcagtggctcacgcctgtaatcccagcacttcgggaggctgagaygggcggatcatgaggtcaggagatggagaccatcctggctaacacaatgaaaccccatctctactaaaaatacaaaaaaaattagctgggcatggtggcgggcgcctgtagtcccagctactcaggaggctgaggcagaagaatggcgtgaaccagggaggcggagcttgcagtaagccgagatggtgccactgcactccagcctgggctacagagcgagactctgtctcagaaaaaaaaaaaaaaaaaaaaaaaaaaaaggaaayaaacttaaatagataaactttagtaattagtattttggtattttattttctttgaaattatctacctatttcatgaatatccgtcatttaacttagtataactttaagatttcaagtaaccaaaaagatgtcggaaactatttttaagtcactgtactataaaacagttattgttgaaataaagtttgtcagagtaatgactcaatctgaataaaatgccatctataagtttaatagccttaaacctcagtagttataatgttagtttgactagtaagtccaagtagaataaaatgtatatttcatgttgacaacttgaagacgtaactctctttaattaaagaaataatattaaactggtagtagcggtgaatccatacgggtatgcagcatccttacatcttgcctccttagaagaaagagttcagctgacggacatacgcagagtgagagaccgaggcaagttttagagcaggaatgaaaggaagtaaagtggaagatggccaagcaggcgacttgagagatcaggtgcaccgtttgaccttctgacttggggttttatacgctggcatgcttctggggtcttgcattccttctcgcctgattctttccttggggtgggctgtccacatgctcagtggcttgccagcacttcaaagggtccgcatgcacagtgtgtttactggacgtgtacgcatgcccacttgaggtattttttcccttagcaaatccagtgttcctagaggaaggtcatccgccattttgccttttagtgccatgcttgagcccacttacccaactcctgcgatcttagccggaagctgctgatcagcagtttcaggctcttcctatctgttgggagcctgcctttccctggtgccagctgcaaccaattattattttagagagacagttaaggactgcctgtccatcacctgatggtcgtctgacattcctggttgtggggaaagggaacmctctcctgccctgctcatgtctgactagctacctgctgtaacaaaactagttttatttaccaaagattatcttatatcagataaacttgaaaacatgttggttatatttaaccattaaataatatatttggttatatttctgagtgttttagcaatacttataagygtttttttaagccaacttagaatagaactcatttattaatttggtaataccatcatgaagtgaggaaatgtcacataggtacaacgtacatacatatatacacacataaacatataaagatttatttattttaaaatttaatttatttaaagacagaaacagatagagattattttaagattttagccacaggtcaggtataaatatagaaacacaaaactcacaaatttatatgagctggcatttttgtctttttaaaaaaatctgaattgtatttctggcagatggaacaagaggttacctgctcaatgagggttaaggctttttatcaatattgttggtggagacttaaaaaatttttttcttgacataataatttaatgtagacagtagcattagtctcaggttattgttttagtcaacagaaattaaagccaggtgacttttgggctggaaatcaaagttattaatatttccttaggtgtttacatatcaaagagatggccctcaggtccttgagaagacagttttgggtggtagaatattttacagctgaaggaggaagagaaaggatgtaaactttcaagtagtccctttaaaagggagttttcgggcatttttgtctgttacagggttgctgcgtatcattgttgttattatcaattgttattttctgggacaaacagtaaattcttctggtagcactaagctttrtcaagcaggcattttaaaagtggggttggggggatgatttttgatgggtgtgaattttaagttcttgtctaaatctaatttatgcttgttaattttgttaagggagctatccagtctaaccatgatacacttgtttccttctttcaacttgatcctcccataggtagcaatacgatgtttatttagggtgagagctctctaaatatccttttaaacataaaagctttttcaaatcccagttccatcatctggtctttgacaatttaggatctccaaaggtatacgtgctccaaaatgtgacacaaaaccagtaagacttttatgactcaaaaccaatcatccattttatggtttaaccggggaccaagagttgtccccagagagggtgcagaagactctgccctcatgatggaaagtcattcccaaaaatagccaaagagaaagcgagctgagaccctcatggtcacaggcagcaaaaatggtgtttgtgaaaatggtatctccagcgttacacaaaagtgaggcacctgcaatcacagacttgtggacctgtgacacttgggaggcaatacggagatgggactttttcagcmctaataagacaatgaggaaggacaacaagtgccttgtatgagctgagacactttatttagacaaattccccagattgctgacatagccaggtgggaaattttgctagtgttttttagggtccttgactgacagcgagcacctccagactcaggcccaaccacctgtgcttcccagtgggcaaaaacacagacagaggtgaggcgtggtggctcaagcctataatcccagcactttgggaggctgaggcaggaggatcacttgaggccaggagttggagaccatactgggcaagatagcaagaccctgtctctaaaaaaaatttaaaaattacctggacatggtggtgtacatctgtagtctcagctacatgaaggctgaggcaggatgattgtttgaccctgggagtttgaagttacagtagctatggtcgcaacactgcgctccagcctgggcaagaccttgtctctttaaaaaagaaagaaagaaaaaacaaaacaaaacaaacagagcatgctgttactagatctaagtcaagttctcgggacagaagggaggacttcatcgaatttcttttttattggggacccacaacaacatttgcccaaagggtctgtagtctgctgagaactttaaagtcaccagtctgtgaggctggctcaaacaacaggcttatacacctgtgccaatattctattctatgattttcctccttatgacaaacaacacaaaagacagagacaaagagaaaacaatggctgtctccaggaggaaaaggattaatcacaaaagtcctcaagccaaaaatcacaaaagtcgcaatacccaaagaattatttcttacaaatgttttctcctgccaatctaaatttggagaggaaaagacaaggaaatgctcatactgcactccctcaaccaggctctctgcagaaatcttggggggtatgtggggggatctttttgactgggcatggtggctcacacctgtaatcccagcactttgggaggctgatgcgggaggatcacttgagtccagaagttcgaggctgcaatgagctgtgattgcaccaccgcactctagcctgggcaacagagtgagaccctgcctctaaaaaaaataagataaaaaaagcagtttttcaagggtgtacaatctcctacagcattctatctattctttgattaattaccctcaacccatttagccattaatttattgaacaatgtattagacatccacttcgttccaaagactctactttagggttgaaaaaaacctaggggtgaacctggcatggtttttgccctcaaaattcttaccctatgatgggagagagggaagatatgttcatgattaagctctaagtcagaatggtgaaaaaaatcctttatagaagtacaaagatggagcatgcctcttactaaatagttgtaagagcgagcaagagttactaaagcacttcaggttaaggggaggcagagggtaaggcaggttagtgatagggtacttgtaaaatctccaaagcatgaaaaattttctaatgttttgaagtagcagaatataaagtttgtaggagacaatgtccaaagaagagactgaaatggtagtttgaagccagtctgtgaatccattgaatggaacacttcacagtttagttgcctcttcttgattacagagacttacagaggcatttcaactggaaagtgtttgatctgctttgttcatttgaggaaacaactttgctggctgtgaaaaatgataaacagcatgagggagaatttgctggcaaaaaacaaaacaacaacaaaaaaactaagtttataatgcaacagtcccattaaagagtaacatgaggtgcccttatatacttttagtggcaatgtataacatttggaagtaacttggtagtacttattaatcctttgcaaatctttgcccaaatgagtgacagggtctcactctgttgcccaggctggagtgcagtggcatgaccttggcttactgcaacctccacctcccaggttcaagcaattctcatgcctcagcctcccaagtagctgggattacaggcatgtaattacatgcctggctaatttttgtatttttagtagagatggggtttcaccatgttggccaggcttgtctcaaactcctgacctcaagtgatccacccaccttggtctcccaaagtgttgggattacaggcatgagccaccgtacccagactacaaaaatgtatttatggggatgttcaatgcagtagcagctcatatgtccattcatagaagatgggttaaactctgacgtagctaaaccagctaacacttttcaaccattaacaaagaatggtagagtggaatgtggtggcacatgcctatagtcctaactactcaggaagctgaggtaggaggactccttaagcccaggagtttgaggtcaacctgggcaatatacaatatagtgaggccctgtagagatctataatatgttctgctgtaaacatawgtccacaatataagggccatttttttttttttgagacagagtttcacactgtcgcccgggctggagtgtagtggtgcgatcgctgctcactgcaacctccacctcccaggttcaagcaattctcctgcctcagcctcccgagtagctgggattacaggtacctgccaccatacccagctagtttttttttttttgtatttttagtagagacagggtttcactatgttggccaggctggtcttgaatgcctgacctcgtgatccacctgcctcagcctcccaaagttctgggattacaggcgtgagccaccgcgcctggcctaagggctattttttaagttgcaaaacaaaaacaaagttttaacagttgtcattctgatatgtagaattattaggaaacctacactatttattttttatacttgtatatactttgtggttttgttgttgttttggttttttgtttgtttgtttgtgtgagacagagtctcactccgtcactcaggctggagtgcagtggggcaatcttgggtcactgcaacctctacctcccaggttcaagcaattctcaggcctcagcttcctgagtagctggactataggcacacaccaccatgcccaaataatttttatattcttagtagagatggagtctyaccatgttggcaacgctagtctcgaactcctgacctcaaacgatttacccacttcagcctcccaaagtgctgggatcacaggtatgagccaccgtgcctggcctatacttgtgtatactttgaattgtttcttttttcttttcctattttattttattttattttatattttattttattttattttttgygacagggtctggctctgtcacccaggctggagtacagtggtgcaatcatgactcactgcagcctcaagctcctgtgctcaggtgatcagcctcctaggtagctgggactacaggtgaccaccatcacacccagctaatttttgtattttttcatagagatgaggtttcaccatgttgcccaggctggtctcaaattcccaggctcaaatgaacctcccacctgggcctcccaaagtgctgggattacaggtgtgagtcaccacatccggcctgaattgtttctattattcacatataactttgtaatcttaaaaaaaatacttaagactttaaaacaaagatgattagagcctggattaagctagtgtcggcagcctgaggagggaaggttttggatgccattgccaaagtagattgaagaggaattggaatttgagggatgcaggtgattaaaggagagggggaagagtcaaaggtgacactcacatttctagcttggtaaattggttgtttgtttattccattaatagaaatagagaaaagagacagcagaggagggcttcattgaggaggatgactttgttagtttcattttggatttaagtctgagggtcctgaaaaggcagctatatgtttggcttgaacctctccactttccaccttctcagtaattcattaatattttggatgtcctagcctgttgatgtgtgtgtactggaggtggtggtggtgggagctaatatgtttagaagttaacatttcatctgtctttatccttttactctcctttcattcagaccctacaattattgctacagggaagaaatgtggccttgcctgtgaaaatctagtttttggaattttttttgcttgttttccccctaaaatttagctccaaaagagagaagattcttaactagtggaaaaaatgtcttggtcagaaacaggagaaagaacatagctatcctagacaaaaataataataataataataataataataatcataaaagcaagggagggagggagaaagggaaagaaagagagacagaaagaaaaaagaaagaaaagacaggaaaggaaagaaaggagggctaggcatattgcctcgtgtctataatcccagcactttgagaggctgaggcagaaggactgcttgagcacaggaggtcaaggctgcagtgagccatgtttgtgctgctgcactctagcataggtaacatagggagaccctgtttcaaaaaaataaaaaataaaaaaaggaggaaaggaagaaaattccagtagaataaagaaaaaaggaaaaagaacaatatttacaagtacctgcagagagaaggtgagaagatgaagacctgttttctacttttttgggcagcactgctaaagaaataaaaaagtacccagaagtcgcaggactctaataaaatggaacatcacctctattcctgcctgttctttggaggagtagaaggtgaggaaatggggaagtgcaggatgagtgattctggagaagacatggctgtgctcatgttgggctgatgatgtcactgataactaaaacaaagggctcagccaggcacccagaagcctcagggccaccgcaccctaaggaccatgcaggctgagacaggactcttttcagtaatccggaagatggctccaccctctctagtccaggccataccctgggccatacccttagcagtgctacccaaaaaagtaaaaaacaggtcttcgtcttctcaacttctctctccaggttcttataaacattgttctttttccttttttctgtattctgttggaatcttcctttctttctttctttccttttttttttttttttctgaagcagggtctccctatttttttccatgccataccctgaaaaaaatctctggggagaggatcccaaagagacaaaggctaattttctcaccatgcttatagattaggggctttgagaaaatgagggtatgtttttaaagtattttaatagtggactgatctattttacctcctggaccagatgaaatgggaactgttccaattcatggagcaaccagacatacatgttcaaayaattatgaaaaacatacaacagatatttatcaacaaatacatcagtaaacaaacttacatgaccctgcttggccatcactgtttcttttcaacacacacacacacatttacaaatacatatatatgtgtgtgtgtgtgtctgtctgtcgatatatatgtgtatatatatatatatatatatatatatatataaataaaataaataggtaagagctgcttatagccctgaatccccacagaaaaccccgtctgtctttagtttcatgaaagcattgtactttttctcattatttttcagaccatcacagacacttctgatcagtgttccacttaagcttagccccaaatacacagaggaattttatactgaaagttaaagaagcgacagtagttagattatctcatgcctcctagattggctggctttgagcactttttcaaagtgtgtaccaactagggtttgtccaccaagttgcaatggcttgtatttgagtcagccatacgtgctcatggataaaaacaataagaactctttattaatataaatatactctgtgaaggcaaagatgtgctttaaaggaaatttctgagcatgtgagaagtagatgagttacatgaggttaggagcatgcagctgtgaccctaaatggggagaatacagccccagggagctgtgatgcacggccactgggaagctaatgaaatgggcagagccaggaccagtggggtagaattaaggcagaagcttccctcttgtgctggacattgtgctggtctctttcctgcccagcacatgccaggtaggaggctataatgtgatcatgggtcattccatgccacaggaatggattggcctgagctggccttcttcataatccaggaataaggagaagaaagaggtaggacagaagatggtcctttatgggggatgagggggatggaggggggaagcttctagaggaattggaattttcacagaaagacatttctgcttagatactaatacagacgtacatatttggacaatatacatgtagaataaaaattatttgaattacttcaacaattatgcctacttttcaaaaggctttgacatcagctatataatttagccatttggcaatattaatcataacttactaaactaaatttgacattgggataacagaatggtaaaatgcaaactgaaatcatagctttatgatcacatgaatttccttcaacagctgttcactgttattactacttatacctttgttagcattccaagaggatctgataatcatagctagcattgattgagcaattattatataccagacattcttctaagtgccattatctcatttaccctacataacaaccttatatggtaagtatcttttcctagtgccttttattgatgacatgaatgaggcacagaaaaaataggtaacttgttcaagtccacacagctagttagtggaagagcaggaattgaatccaggcagggtggtttcaatacttcagtcttagacataataccatattgccttcctggtacaatggatgctttacgtaggaggtgttatagggagaaattcccacattttcctttttatacttgtatattgtttgaatttgtttataataaggatacatctcttttgtaacttgaaaaccacaaagaagaaatagaacaataaccccattcctttaaaaatagcattgcagtagctatttcaggtagtgagatatcaaactggttttaacttttttgtttatttgttttagttttaagaatatccaaacaaagacggatacatgtgaaaacttgggacagtaaaattgtgacctttctataaagacaaagaggtaggaatcaagccaaagtgagattaggataatgtcaggtcttagtactctattctgcataatagtttattttaggtaattctctatattggttggcttgctgaarctggtgtgtgtgtgtgtgtgtgtgtatgcgtgtgtgcgtgtgtgtgtgtgtgtgtgtataaaaaatctttttagtcgttcttttttatttgtgcttctcaacatgcttaagcaagtgatatctttccatataaggggcaaaagaatttggggctgtgaggcaggctgacaaagaggaaatatatcctgtctaagcaagcaagaaaaagggaaaggagtgaaaattcttgcaacatttagctcttccgaaaaaaaaaaaaaagtggtcatgatttctcctatagtagttgatttgtcactttacacaaaaggcctagaaacatatccattatagatatgcctccttggggctcagcctctatctgtcaagtaggggtaatgggtcaatggaattgattatgtgatctataaactttgttccagctttaccatattgtgaattttgaggtttggtcaatgaatatgcaaatccaaccagaagtatcattggatacaaaagtatccgtatcatttttgagaataaaatttccaacagcatttttatatatatcagtgaagatctgtgtcacaaaacaaaactttatgaaataggaaataatctggctgatctttgacagtacaaaatttgacattccaagtcaaattttatgtttaggtagaatagggaagtattggttttgcagttttaccatatcaacacatataatatttctgcatagaaaaacggaccatctaaatgggaaaggggagagccaactagtgggtaaaatgctgtaacagtattttaatgctcaaggcccaattatgacttgaagatgttgttgtactgattagcaatactaactgaaaatttttctaacaggttcataacctaagtattttccagctatatactgttggtctcagggattggcaaagctgaatcagaacacttctttgccaagacttgtctgcaaattcttaacctttttttgtttgccaagaacaaagaaaaattgttgtaaacttagctgctgctgtaacatatgagcagtcttttccgaaaatgcaaattagacaaacaagaatcattacatcatttgcagaaatgcagttacatttggtttctgctattgtgtgtgtatatatatatatgtatatatattactttcatatcttacttgataccttttgtagtgctttaccattttcaaagcacttgcatatgtgtcgtattatttgatcttttctgagatccaaagtttttaacatgcttcatgcttgaaaactttgatacttcaatttatatgatgcatgtaacatacaacaaatgttttgattatggttgtatggaaaattcttattatatccccaaatataggttacacattttggcaaagtaagcagttattgatttttattgccacatgaactggattttcaaatattaccaaatgcatgtgtttttgtttttgtttttaatacaaaaacatcatctaatggatagtgatttatgccagtatgtaggaaataagcaagtattttgggtcaggtggattactgctgaagctttgattaggcttgaaaatttgatacactggaaagctaactgttaccctatagattactaacaaactcattgcttcaaataaaactgttattgattgttcagattaaaaaaataatgtcgacttttgttttagattcagggggtacatgtgtaggtttgttacacaaatatattgcataatgctgaggtttggggtatgaatggtcccatcacccaggtaatgcaagcaacatgattttattcttttttatgactgtgtagtattccatggtgtatacatatcacattttctttatccaatccactgtttatgggcacataggttgagtccatgtctgctattgtgaatagtgctgcaatgaacacgtaagtgtgtgtgtctttttggtagaatgatttattttcctttggatatatacttagtaatggaattgctgtgttgaatagtagttttaagttctttgagaaatttccaaactgcttttcacagtggctgaactaatttagattcccctcaacagtgtataagcattcccttttctccacagcctcgccagcatctattattttttgacttcttttctgactggtgtgaggtggtatctctttgtggttttgaattgcatttctttgatgattagtgatgttgagaatttttttcatacgtttggtagctgcttgtatgtcttcttttgagaagaagtgtctgttcatgtcctttgcccagtttttttgttttgttttgttttgagacagggtctcgctctgtttcccagaccagagtgcagtggtgtgatcagctcactgcagcctcaaattcctggctgaagcaatcctttcacctcagcccccaaatagctggaactacatatgtgtgccaacacacccagctcattaaaaaaaattgtagaaacaaggacacagtatgttgcctgggctggtctcaaacttctgagctcaatgatcctcccaccttagcctccagaagtgttgggattacaggcataagccactatgctcaggcctttgctcactttttaatggggttatttgttttttgtttattgatttaagttctttatagaatcttgatattagacctttgcccactgcttagtttgcaaatattttctcccattctgtaggttgtctgtgtactctgtcaattgtttcttttcctgtgcagaagctcttcagtgtaattaggtcccacttgtcaattttgtttttgttgcaattgcttttgaggacttagccataaattatttgccaaggccaatgtacagaatggtatttcctgggttttcttctaggattttaaaagactgggatcatatgtttaaatatttaattcatcttaatttttgtatatggtgaaaggcagcagtccaatttttcttctgcatatggctagctaattatcccaataccatttattgaataaggagtcatttccccattgcttatttttgtcgactttgtcaaagatccgatggctgtaggtgtgcagctttatttctgggttctttattctgttccattggtctatgtgtctgtttttgtatcattaccatgctgtttttgtatcattaccatgctgtttttgttactgtagccttatagtatagtttgaagttcagtgatatgatgcctctggctttgttctttttgcttaggattgctttagttattcaggctcccttttggatccatatgaattttagaatagcttttctaattctgtgaaaaatgatgttggtagtttggtaagaacagcattgagtctatagattgctttgggaaatacggccattttaatgatattaattcttccaatccatgaacatggaatgtttttccatttgcttgtgtcatctgtttgtttctttcagcaatgttttatagttctctttgtaggtatcttccatctccttgcttagatttattcctaggaattttaacttttgtgtggctattataaatggcattgcattcttgatttggctctcagcttgctgactgttcagattattgttttataaaagccacaaaaatgttccattagctaaaagtcacgtttcttagttaatagaagtcatagtacataagaaggtaagagtgtcaaattattactagttgtgaatgaattattactagttgtgaaagaatagcaattcatggttttgtttggtcagcaactactgcaccctagtgatgatgaattctctagcagattggaaagatacttagggagggaaaaaagatgactttattaaggatctctggaaataggaaaatatttaagaaattctataagtaaaaatgagtaattttatgtcagaataaaataaaatttggctgaatttatagttctccatctgcctgcttgcacctatttggggcttattttacctttgtggttaccctgagaagcatggtatggctggagcctaagtgagttctttgttttccaaccacattgtcctcttttctttttataaaatacatcaaattccttgcaggtttgtctgtctggagtacttacccaccttctttacttagtaaagtactacttcttttttaggtgtccatttaagttcaaatccttgaagaacttttattttgtaataaagattagattcatatctcctgttaaacactcttatagtattcaggatataccttctaagtggtacatgtggggcggccagcagaagaagattttgtattaggtatcacatttgagaggaaggaggccccgtggaaaaagcttcatcaaaagaaaacaaaagaggtgtttatatgtttctcaaaaggcatgtatctatgtgttggtgaaaactgccttaataagtattacatgtctaatgtgtgtatactaacatgcagctctacgaaatatacaaaaaagttaagcatatagcctatgcttttgaaagcttgagatatatttgngggaagtaactatgaaggggatgtcccatgtagcctcatatggagcataaaataatgaaatgctatttattatatgtcatgtatgggactggcctgtatggggtcatttgagtgctaagacaagatttctttaatttgcagtactttcccacaatattcatatgagttaatacattatacttaggaaattgcccctaagataattaaattaaaaatatattaccatattaacatgtaaacacaaattggtttaaatgttctctagcaaagatcaaatctaggacagagaaacaggagaagaaaacaggaaaatggggctcagagcaggggaatgctgtgttgtttaaaagccctggatgtcaagatctaaggaaaagataaaaaaaatagaaccaccaccaaatataaatatttatttccatatctcacaattttttcctaggccattgctggtgacagactttccagtccttttcagaacttactcatcacatccttttcatgcttgttattttgatcctgaacatccttgcaattcaaagagcatacagaggcagagtgaaattagcataatgtcacctattgctatgatgctcgttacctctacctccagaacatgccaaggaggcttccaggagccccagaaacacagaacagcaaatcttcaaaagcccagtgcccagagcagatagagaagaaaattctattttgaaatccataaagaatctcataattccttgcaatatctagtcccaattgtgtgggtgacaaactgacctatggcagaattaggaatgtgaataggaatgaggcttggagttccccattcctgctgccctaactcccactggaatgtaatttgtacaaagagtgacgacatgtgaagatgtaaaaaagaggactagagatgtcctcctgagctgcacaaggaagaaagctttttatgaccatccaattctgcaaaggacctagtttcccagtgcttattaccataaggatgcagaaagaaaaaagttcacagacataagatttcatgtgaaaaccaagaaaaaaaggttactgtattttttaaaggaatagcatttgatttggtgtaatggcaggataaagaaatgagaaataacagtggggaaaaaagttgactacaaagatgtgaataagatcagatggcatagtaattttattcgtaattaaaaatctggttcagttaatggagagatttaatttcaggagcattaactagtagactactggatacaatgtacatgtttaaataaatcataaataagtttctcctaagagctactttaatgttgtagcattctaactaatgagtagtatgacaaaattacgttgttattataatagcaatgtatcagtttttctgttgatgaaatttcttagggttagaatttttttttaccagatatgaaatagacttacacttaaatactgttgaaagttgccatataatgtggctattatcttggagttaattaaagttaatttagttttgagcattattaagctctttaagaaaactggaagacatcaaattcttataaaggaaagcaggacctatttgttaaaacaaaaagaaatagctctgtattcaagagtagttttctcaatggatactttgcccgtaaacattaaaactcactaacacttaaaataaatagatttgaatggatggctcttaccacaagttaaaggttgttatttcattaagctaaatgtagtacgtataactgatttttttttttgagggaggaggcattaccttggagaaggaaatggcttcagataacatctatgaaaataataataataataataatgagattatacgcaagatttgaaacattttcagagttggatagaaatttacacaaaccagatttcccctgggagatcctaagataaactaacaataatgtcacacacatatcctgttattttatttactaaattctaaattaaatttctgctctggtgctatgaaggtcacccagcgtactcttttagataatacaggagattccaggattgaaccaaaaccaagctaagcagaatattttccttccgagagatttgaaatttgtgataaacacgtttgattttttgtgtgacattatttggtaaaagtaactttttcagaagctcccccaaatctctatacccttctttgtgccaccgtgttttcttgtgtattggaggtggataagcaaactgcaattgggatagattttcacctaaatttctcacattttcataagtgttctgttcctcttatttactgcttgcaatccacatgtgtatactgcacacacactcacacacatatacacacacataccctcatattctaaagaataaaaacacaggcactgtaattgcatatgtgtatacttagggggttaaagcctggcttcaccactcagtgctggtgtgaacttggagagcttacttagctcaggtccttttgttttcttctgttgtttgtttttgagacagggtctcactctgttgcccaggctagagtgcagtggctcagatttcagctcactgcagcctccaaattccgggcttaagtaatactcccacttctgcctgtagctggtaccacaggcacgtgccaccttgtccagctactttttttttttttttggtagaaacagggtcttgccatgttgcccaggctggtctcgaactcctgggctcaagggatccacccgcctcggcttctcaaagagctgggattacaggcatgagccactgcatccagcctagcccaggttctttacctgtacaatggggataagagtactgatatcacagggtggttgtgaaattaaaatgagatatgtagagatatgtaaagctcttactaaagtgccagcaatataggaaagaacaacaaatgacatttactctttttatgttgtctaaagtcatatgagtatatagtgaagttttcagcataggctctgtgtgagaatacagtagtccccccttctttacagttttgcttttggcagtttcagttatctgcaatcaactgcagtctgaaaatattagataaaaaatcccagaaataaacaatttctaagttttaacttgtgcactattctgagtagagtgaaatctcgcccatcctgttctgtccctctggggacatgaatcctctctttgtccaggggatctatgctgtctacactccccaccctttagtcacttagtaaccatcttgatgatcagattaactgtcacaatgtagcagtgcctgtgtttaagcaacccttcatgtaatcatagccccaaagtacaagagtagtgacatcaacatgttattattattattgttcttttttattattaagtattgttgctaatctcttactgtgactaatttataaactaaacttgatcataggtatgcacgtataggtaaaaaatagtatatatagggtttggtactatccatggtttctggcatccactggggatcttggaacatattccttgtggataacggggaccactgtagaggcaaatggatatagaatatcctttaggtttatttttttgtctgtctttccctaaagcaataaatataaagaaaatctaaatagttggttttgacaacacataggtgtattatattctgcctttttagtgctcagtattccaatatttcattttgtagatgtgaaaattaaggtaatcaagggtggaaatgcttattggagatcatggaactggctcgtgatgcaacagtcatggagtgctggtttaaccgagttgaatacaacacgaatgcccccatgaaaagcaatgaatacagaagtgctcaaaagagtttacctaagaaaataaataggaagaataaaactcaaagacagagaaggtatattaatattcattatcactgaagagaagtaaacttaattttttaatattataagttaatgacctcaagcaaagtcagatattgaaaggtgatcgtttcaaagattgaaactgagtgaaaatatttcaggaaaagagagttttagctattcttaaagaaagagaaaaaagcagattcaaggatagctttttgaagaagatacagcttgaaatggcttcttttactccctcagttaaaagtggtaatggatgtgcctaactaaaattcccacaggaaaaacttctttagttcacctctctcttcctgctttttttagttgatttcctatgtaaatatgagagctcttaataaaaatatgacagaaagttggaaagagttttcctgaaataaataccagatgagtatagtggttacttgaattatgtgcagtaaaagaagatgatactctacaagctcggcttttcggcgacaaatctgaagtccatctccattgtgagtatttacttgtgtggcttggacttcctccattccagagaaagaatcagtcctttgggaatccatgaagtgtgtcctactgtgccaggcctcagccactaacacaggtccctagagagccacgctgtcttgctccatgacctccaatgagaaccccttcttactgccctttcattgattaaaacgagacatttgctgggacctcattgtgggctaagcacattgcagtcagtttccacataatgttgctcattggatcattattttaatttttctctctttacctcccccacagctgtctttccttatctgcaatgttgcatgcacaatatttactttcagcaaatgatgtaaatcacccttgaatgaaaagactgaaggtgcctcacctttcttcttcctgtcctattactgtgttctcatggccttggattttctctggataaccacgtatcctagttcatgcttttgtgtcataaggaaaagttggcactcccttttgaaaagctaaacttcccttcctgctattcatcctgacatttctgccctttattaggaacttgattcaacaattttctcttctcttatatcttcaatttctccctttcttgtttctttcctttaggcttaaaaatgtctttaacatccttaggtctttcctattgttaaaaacaagcaaactcagaatccttttctcaaacttaatactttgttgagttggcacccaatttgcctttttttttttttttgagacagggtctggctttgtcacctaggctggactgcagtggtgccatcatagctcactgcagcctcaaactcctgggctcaggtgatcctcccacctagcctgagtagctaggactataggtgcccaccaccacatctggctaatttttgaatttttcatagatatggagtttcaatatgttgtccaggctggtcttgatctcctgtgctaaaacgatcctccaccctcagcctcccaaagaagtgctaggattacaggcatgagtccacgcccagcccttaatttgtctatttttattgttaagtttctcaaagaaatgctcaatgcctgggtcaaggacctctacagatcttgagtctccttaggacatccctttccaactactcatctatttgatgccagattttctacatgtacttcaaccaaaacaacatattgcaacagattgaatgcagaagcagatatgagaatctgctgccttctatgaagcaagacattaaagagatttgcaaaaatgtaaaccagtgctctcttcttttcaaaattatttttattagggaaaatatatttttcataaaaactaggttatttatattactatttaatggagttagcgttgctatttttaaaagagtttatttaaaaagtcttaacttctttagtggtaatttctagtacggtaaacactggtagatttaacccacagaatcagaagctctttgggggtcctcagtaattttaatagtgaaaaggagttttaaaataaaagtagttgacactttatgaggctgaggcaggtggattgcttgaggtcaggagttcaagaccagcctgaccaacatggtgaaaccccgcctctactaaaaacacaaaaattagttgggcatggtggcacgtgcctgtaatcccagctacttgagaggctgaggcaggagaatcacttgaacctaggaggcagaagtgagcgagatcatgccactgcactccagcctgggagacagagtgaggctctgtctctgaataactaactaactaactaactaaataaataaataaaaataggagttgcaaacagtaggtctatatccgtgattgcttttcctcaccactgttgcctcctttttttaaatctctgaccaaagaactggctccacttggtgtcctgtatcagatttcttgggccggccatggtggctcattcctgtaattccagcactttgagaggctgaggcaggaggattgtttgagctcaggagttcaagaccagcccgggcaacatggcgaaactctgtttctataaaaaacacaaaaattagctcagtgtggtggcatgtgcctgtagtcccagatacttgagaggctgaggtgggaggattgcttgagcctagagggtggaggttgcagtatgccagaccttctagatacaagcaagcctcttaccttagcttcctgagtggctgtgatttccctagtcttttatcctccctagttgctaagcaatgtttaacagtgcctacctctcatttcttcttgatattctttccttctacggcaacaaattcccctgatttcttcccaaccttcctgactacccatctttttctctcttggttcctttttcctgggactgtattttcctcttagctgactcagtatgcttttccttaaagattttttttttctattgcccttccaaaattttttctagatccaaagcctttctcacagtgtcaagaaaaaaacattccagttgccagatgaacagcctgtttcagtatcatgggtctaaaaccagacaccggtttttcctccagcaattcttctggttaacttgatgcctctgtctatcatggaaaccgaatttcctaagtcatgcggatttaaaatgctagaaaatttcttactcctgtcaccactacatctaatgaatcagatgttctgtttgttcttgtgtcatcccagtccactccctgacaaagcatatctgcaagcttatcatcataaacctaggctatttcaatgctcacgtattaaccgctcatcacatgaatagaatttcatttgcctgatttaccctacacagcccttcaaatttatcaacgaaatcactggttttcaacttttatttttaagtaggaaaagcttttccgttaagtttttgcaaacaaatataatgcaatccaatatttgccctccagagctatgccgatttaccgctgaaaccttgagcaaagaaatactcaaagcttcttctaggttgtgtatgtatcacaacagaggaaggaaattatgagatgggcacttgggagactgttttcttggttgccctctccttgtgaaaggtagggctacaagcccccatttgagccaaagctaaggagtccggtgcccatgaaaaagacgcaagcaatgctgtcctccttgatggaggctgcagaggccagaaccacacctgctcagcctggccctgaggctgcccctgtggcactgctgaaagtcagtcttttgtcacaaggaaggcagtttttctagacaagattattctcatcttaagcatgaggtaggggtgtgtgtgtgtgtgtgtgtgtgtgtgtgtgtgtgtgtagtgtctaagtctacttgcctgctttctgggaactggtaagagataggaagatagaagtcatcatcattccaaatgtaggctttcacttaatttttctattttcagtctgagaccacacatttacacgtctctcagcctgcatccccaagctcaaaatatttctgctttaatctcttcagagactaaacctcctgtcccccactacatggagaaggcttggttacctgttattcaaggtgttgcctggatctgtgtatatactttaattcattccctctgttttcagcaccaacacccgccccctttcctcctagcttccttggtacttggtgcctccaatttttgaggctttctataattacttagcacaaatcaactttcttgttgattttcttctttataggagcatagatttcagcatttgtgactttgacaagtcagttgttacaaattcatcagctgcccatctgataaaattttaatgtcttttctactctatctcttctagcttttcttttcttgtgtgtcgatacccattttatttctttacttaccctcattttagtggcatttcaaaaggcgtactagttacctattgctatataacaaattaccataaacttagttgcttaaaacaatgcacatttattctcttagagtttctgtgggccaaggtactgggtgtagctcagcttggccccctactttagagtctctcacaaggctgcagtgaggtgctggccaagactgggatctcatgggaaggctcaaaaggaaaagcatctgcttgtatgctcctggagttacaggcaggttttagttcctgatgagctgatgaactgacagtcttgttctttagtgactctgggccagaggtcaccctcatcccttgccacatggctctctctctatagcagtttgtttaatcaaagctagcaatggtgagaatctgccaacaaaatagaagtcactattttgtgtgacataatcacagaaatgacatctcatcatgtttgccacattctattggctaaaagcaagtcaccaggcccgcccatactcaaagtgaggagattatacaaggcgtaaataccaagaggcagattagaggctattttagtctgttgatataggaggccaaggtgataaacacatgggtccaagtctctctctaaaactggagtcccctctctctcacttccatcaagcttacagtccacttctcctgtcaaggtcaagtagtgacctccatcttgcacaatccagtgaactatcccaagtgatcatcatactcaaacaaacaaccagtagcaactgacatattctcttcctgaggcattttatttctttggatttggggatccctcacctccttgtcttttcccttcatctcttgtctctgactcacaggctcctttgttcattctcatttttcttccttttggagggctaaatgctagaggtctacagggctccatttgtagcccttcactcttctgtaattgtacctaagaaatctagtctcatgacttcatagtccatgtatatattgatgactcttacatttatatctccagctccaacctttcccctatgccccagatagtacccaattggcatctgtacttggactcaaagacattgcaaacttaatttctcaaagaattaaaaatagaactaccattcgatccagcaatcccactacttggcatctactcaaaggaaaagaaatcattatatcaaaaagatacccccacttatatgtttattgcagcactactcacaaagggcaaaaacatggaatcaacctaagtgtccatcaatggattggataaagaaaacgtaatatatatacatacacatacaacacacacagacacacaccgtggaatactactaagccataaaaaataaaatcatgtcttttgcagcaacatggatggaactggaggccattatcttaagtgagataacccagaaacagaaagtcaaatattacatgttctctacttataagtgggagctaaatatgtgtaccatggatatagaaattggaataatagacattggagactcataaagttgggagggtgggaagggttcaagggatgagaaattacttaatgggtcaatatacactaaaagctcagatttcatcgctattcagtatatcagtataacaacaaaactgcacttgtaccttctaaatctatacaaataaaagctaaaaaatgaaaacaaattagacatctcaaatgacaacttaatgcagaactcttgatttcctcatccttccctgacctttacctaaaaacacactctgcccaaactgatgcccatttcaataaatgtcactaccttccacccagttgcttaggtggaaatccaggcattttctttgttcctcttctttttttcacaccccacatacacttctcactcagcatatcctgacagcgccaccttcagaatatgtccattatccaaccgcttctccccagttctcctgcaatcacccaggcgtggtcatggttgtctcttgcctccccttgactggtacatgtgccgttcccctttgcatcaagcttacatctgctccaggatgtttatatttgcagttctctccacctgtaattcttatccttctgatttgcatgtaactcactcctttttatcatccaggtctctccttaaataccacctctttggaaagccttccttgatcactctgtgtaaaatagccaagcctccgttattcactatcttcttttgctcttttatttttcatatatgactacgtgaaagtactgtctgttgttatatgtctagttacttgttatgtgagtataagcttaatcaaggtgatgctttattgcacttagcgctgtttccctgcaatccagtacaaagcccagtatgcaagttataggcatgtggtaagtgttggatatgtgcaccagttgttggacaggattgaacttgcgaggtcagctttctcaggtgacctcaaaggcaagcatctagtttattgagtagtacaacaataggtatgttgcatgtacatatatgtataacagaagtttatttttaagcctgaattagtgatagcaactctgttcatgagtgattatgtggttctttttcatctttactctttctcagagaaattcttctcttcttcccacattgtttgactgcttagagtagataatagaggagtggtaagatgtctgagtatataatgtaagggggtttggttcttgtcatatatagaatacatataggtcctattataaacaacatatggttcttctcatatatagaatacatacaggtcctattaaaaacaacatattgtagctttaattcaacacacgactggttcttgtataaagtttcactgagatctttattgtggagaattgcatgactattccagtcctggactcaatttgaataaaaacataggaaccaaattcctccactaaataactgattgatacttaaatttgacaacgatagctttatagaatagtccagaacatatacagtcgtacctcacttaacaatgtggctacgttctgagaaatgtgtcattaggcaattcccgtcattgtgtgaacatcatagggtatatttacacaaacctagatggtatagttcactacacacctaggctatgtggtacagcctattgctccttgactgcaaatccatacagcctgctactatactgaacactgtaggcaattgtaacacaaaggtatttatgcatctaaacatatctaaacatagaaaaggtacagaaaaatgcagtatagaaaataaaatatggtacacctatgtagagcacttctcacgaatggagcttgcaggactggaagttgctctgggtgtcagtgagtgagtggtaagtgaccgtgaaggcccaggacattactgtatacggctatagactttataaacattcttcacataggctgcactaaatatgtattaacaatttttctttcttccaaaattaacctaattactatatcttttcactttataaacttgtattttttaaaccttttgacttttgttatacttactttaaaacacagacacattgtacagctgtgcaaaaatattctttcttcatattcttattctataagctttttctgttttaaagttattattaattattattattttactttttaaacatttttgttaaaagcacacattaaacacacacacacattatcctaggcctacacaggatcaggataatcaatatcactgtcctccacctccacatcatgtcccattggaaaaagtccagggacagtaacacacacggagctgtcactttctgtgataacaatactttcttctggatacctcctgaaggaactgcctgaggctgttttacagttaactttttttcagataagtagaaggagtgcacttaaaagaacaataaaaaggatagtaaatacatagaccagtaacatagtcatttagtgtcattatcaagtattatgtactgtgcataattgcacggactagccctttataccactggcaggacagtaggtttgtttacaccagcaacaccacaaacacgagtaatgtgttgtgctacaatgtcactaggtgataggaattttttagctccattataatccttttttttttcttttttttgaggcggagtctcactctgtcgcccaggctggagtgcagtggtgctatctcggctcactgcaaggtccgcctcccgggttcatgccattctcctgcctcagcctcccgagtagctgggactacaggtgcccgccaccacgcccggctaattttttgtattatttgtagagacggggtttcaccgtgttagccaggatggtctcgatctcctgaccttgtgatccgcccgcctcggcctcccaaagtgctgggattacaggcgtgagccaccgcgcccagccagctccattataatcttatgggaccactgtcatatatgtggtccacggtttagagtatggaaatgactctatttccatacagtacttccaataataaattaagttgtttgatttctagattgaaaatggctttgataatcttgtaattggatttatatgcctttgagtctctcaagtagaactgatttacctttccattcctttctctttcctctctggtcacatccctattccacatttgttttttttgtaaccagatacacaaataatactttgtattaagtggttatagtgaaagctgggcattctgttctagtgaataatgattcttatattccaaggacaaactacctattaataataattgggtattcggggcttaaaagttgtatttgaaagatgcagccaggtgtggtggctcacgcctgtaatcctagcactttgtaaggctgaggcaggcagataatctgaggtcaggagttcaagaccagcctgaccaacatggtgacacctcatctctattaaaaaagaaaatacaaaaattagccagacatggtgggaagcacctgtaattccagctacttgggaggctaaggcaggagaattgcttgaacctgggaggcagaggttgcagtgagcagagactataccactgcactccaggcatgggtggcagaatgagactccatcagaaagaaagaaaggaaagaaagaaagagagacagagagagaaggagagaaggagagaaaagagagaaaagaaagaaagagatgttatccatgatttagtggaaatgagaaaacctagaaaataccatgcaattctaatgaaaattctagaaaactagaaaaaaggaaagagaaggaaattgagaagaccctgtaatctgttgaaatgctgagttttcctaattaaggaaagtaaaattctagtcacttaaaatgcctccaagaaagtcactgtttttgtccatttatatctttctgctttctttttcattttttccctaaaaattaattaaatattaattacttttagaggaaagattactctgataaaatggtcaagaaaagcaaagtttcttactttctgtgccaaagattttcagccaaagtaataaaagaaaaatcttaaaaagggaaactatgcaattcgaatggaagatccattttaaaaagttattgtggcagtataaaatgatactgtgtgctcaaatacctaaaaacttttgcaacttacgaaatggtatttttagtattacttagggtgttgtatgggtgtcttatgtaacttgttaaggtaaagaattttgctattctcaacttcagtttatgcatctataaaatgagaaagcgcaaaataatacttctacctcatagggttatcgtgaaagttaaatgacagagggataaatgaaatatttagtatagtgcctaccacaaaagccaaagctaaataagtgatagccaagaacaaacacagaaaacttcctaaataaaaatatgactagaataactgcaatgtatggaccaacataagcatgtttaagagtgaacacaggtgctattagtaattacacctggaccaaaagtataacccaggatgctccctgacatactagaatttatggtttctctatctataatctattaacatagcaggcagtaaaccttctcttttgtggagaccacacatgcaccagacaagcagagcctggattcaatagtgtgccagtaactcacccagattttcaagaagtaatatttactgggattatggattaatcagagcttgtgtttaccaaagtaaagttcaccaatgattcttcaaatatgttcacaagctaacttggcttatatccatttacttataaatcagaagattccccaagattttactgtctgcctgattaaagctagtatgtgctataagtgttttcaaaatacttttttccaaaactgtccttgcagttaaggtgctgttaattcaaagtacctatgacttcctatcagaaatgaaaatgacacttaatgagaacaaaacatgttttcacttgaaatgcaattaaaccaaattagagaaacagtgtttttctaactaagataaaaacagctgtgtttatgaagctgctctaatggtattagaatttctcttatggaaacttttgctttatttaagatatatgatttttattttaattgacattttagacaatgatactttcattacaattttttcagtcaagtatttctttagggaatctttcctataattcatagtgagctaatttgatcatgtattaatagagatttcatggagatttgtttttaaaggtttttatgtgaaacctttaaaaggcctcccaacaaaaactttacttcatgactagatatgatttaatcatgattatgtcaaaattgtaatttttaaaatgccttaagaaaaataatttctgcatacatttgtgtaatttttctaaaatgcaaaatttgtaacaatttctaaggtgtagaaaaaacatttacttaagttgctggtttttttaatattcatgtgtatgttttgggattttgtagatataacctatgccttagattactacatgttgatgtgacttgctgatgtttcaccaaaaaaaaaagaatgcttccatttctacacttaacatttttttctttatctttcataattacggtccataacacttggagtaacaacatgttttcctgtgtatatataatataaatggttatatacaaacaatagaagaaatacgcaatttcccaaaatgataacatttgaagacgtcattaccaacaacaacatcactagaaacattactgctgttaagagcttgatctagaaaatataagcttaaactgctctgtttggaaacagcatgtaatcgggatatttaactagaaattcaagtacaataaaatggatttaattagttatgtagctataaaataccttaaatttttttaggctatgtctgcatgggcaactacttaaatgtttttagattaatttattttagtcaatttaattttaataattacctcaactatatgttattttcttcctttaaataatcacagaacacgctgttttaggatcaggtagaagctgagacaatctcttttgaacaaattttatttttattccaaaattaattgtcctaaaaatagtacatttagccatgaaaaagagaaaacaagtaaacctatcaaaatgggacactgttaattaactaaacatagaaaatagattcattcattatccaccaaaaatttcaatgtacctgccaggtaaaagcaccatattcagtaccatgaaagtgataacgattccaataacagaacatcttccctcaaagaacttatcacatgtttatgtataagtttaaatgcattgaatgtcaaaaatgcagatagcgctttgatcaaggacattttagcaatgtattcagacaggatctttattttctagggttttcattataaggcagaaaggttagactaaagagtaatgttaaaaatacaaattatttttgtattctagacatttctataagaaatgtatggaaatagaactgtaattttggcagtttttgtcacagtgtcagtgagcaaatagatgtcatactcatgagtacagaaagaggacattctctttaacagccacatacttcttacccagaaacccttggagaagatttataaacccacatactcagaatatggtaatgaggaaatgctgtctgccctgggaaggggaagaggatctaaaacatttaggacaggtaattccacaaccatgccttaagataaatccatgccttgaaaagtaaaaagaacagcaaaaacagctagttagtcaaaggtcaagatagcaaaccctagctggtaaacttgtctgaatctttactgtattcctcaagctataaactatgtttatagactccttcaaacaggattaaattttggaggcattttcttaaaaaaatagtaaatccccactgtaaaattagttataggctttggacaggattcttgccaatggggctcagaggcttaagttttattaatttcacagtaactccaccttagttcacagatattttcaaaacatggaaagtgtgattgaagtcaggtaagtctaatcaaatatgagttctggtgccacagaacggtgatgttgaaatacttggcttttattggctatttatggcttttattggcatattaatgtcttttactgatgatctcaagttctgtctatagaaacactgatgtctgattgtaacagtttaatcaatgtataaaccaatctggatggttcagatctcaattccaacgtttcctttagaattcaggctcaatttatctaaattgggctcattatattattattaattttactttggctgtgggctgagttaaagcacactatgtttttgagcattctaagattgttccaggatttaaaaatttaagattactttggtttcttggaattatttaatacacactgcaattttccctgaaaaacacatgtaagctaaaatggctctatggaaatgttttatgttttaatgaggttgggaaacagagataaattcacctggtcataatcatatggtaaatattgatgaaaggaacctttttytaaactgcatagctataattctattccagctgattttgtagatttaaaatattttaccctgtttttgtgtctcttaaggagtttctgtttgggttatttgtacagatcaacagataaaaacttatgtcctagaacaaaaacagcacacttaaacacatcttttctttcaggccaaaaagtttgctgtttcaggaccatggacctccttaggaacatgtacatatttccctaatgaatccttaggctgtgatatgttttcgagttaaattgttattactgatagaaaagttctttatgtctgccataaatgtgcattaaagtttatatagcattcaccttcatgattggtgttttatcttactgattattttggcagagaacaaataccaaaagtctccccatgagaaataaaaacaaaccacgaccctctaaaaatagaaaaaaagccacaactcttcaggtcctccttggacccatggacaaggctcataaacctccttggtgtccattccatgttctgtgaatctggctgatggtcaaagaaagggctagagacaggatgatctacaaatagaggagattgaatttccaaatgaggtttgatcatctgctctttgtgaattttttccaattgcttccccatgtgccttggtttagcctttcaaaaaattagaattttatacccctaggatgtaaaataccatgtcagcgcactttttgtgcctggaatgcaccttggagatagccttgcccattgaccagctcttcatttttcagagggagaagaaagtgaggtctgggaaagtaaaatgcctgcccaaatccacagagctaagaagtagcagagcagagatcattaccacacattccaaactttcttcctatttatcatttttctccttgagccccttcttgtctgagacactacatcaattaaaattattttataactgcaacatcgtacaattgccatgtaacacattgcccaatgcaattcaatcttagcatctggaaacaatactcatttattaactcacactttgtaggtcagaagtctgagcacagcatagcaaagtcctgttcttagggtctcaccaggctgaaatcaaggtgttgaccgggccgtctcctaatctggagtgtggagtcctcttccaagtccattcaggttgttggcaggattaattcgttgtagctgtaggactgaagtctcttttcttgctagctgtcagccaggggcagctccaagctctcagacgctgccctcaggtcttagatgtgtggccctctcactatacgacagctacttcttcaaagccaataggagaatatttctcttcaggaaaggttcactccctttttaaggactctgctgatgaggtcagacccactcaagacaatctccctcttgattagctcaaagccaaccgactaacaactagtcaagagtggtatcccatcatagtcgtaattctcacttgtgctcaaaggggaggggatcatacagcatgtgtgtaccaggggacaggagtcttgggagtcatcttagaattctgtttgttgggccgagcgcggtggctcatgcctgtaatcccagcactttgggaggccgaggcaggtggatcacgagatcagaagatcgagaccatcctggctaacacggtgaaaccccttctctactaaaaaaatacaaaaaattagccgggtgtggtggtgggtgcctgtagtcccagctactcgggaggctgaggcagaagaatggtgtgtgcccttcgaccgaacttcgcgctcagcttacgtgccacactgccctccagcctgggcgatggagcaagactccgattcaaaaaaaaaaaaaaaaaaaaaaaaaatataccgtttgtcggccaagtgcaggttctcacgcctgtaatcccagcattttgggagaccagcctggccaacatggtgaaatcccatctctactaaaaatacaaaaattggccggatgtaatggcgcatgccaactactcgggaggctgaggcaggaaaattgcttgaacctgggaggtggaggttgcagtgatcccagatcgcgccactgcattccatcctcagtggcacagtgagactccatctcaaaaaaaaaaaaaaaaaaaaaaaaagaattctgtttgtcacgttggtctgattctactcattcaagtactagatttccttttgcctcctcttaccttctgctgccccccaactgagttggttcattgtcttccatcctacagaaatccagaaagggatgataagagaaggtaaattcagactagggtgacgaaaactccaaatccatgaacatatggcatttttattgggttcatgtattctttgcagctgtaagggcattggccagggataattcagaattaccttttcactaattactgaatagtaaaatttacctattctttgggcatgaagcttcttttaatacggctggcctggattcagagatgtctggggacacctgtgctgggttggcaggagcagcagcagctggaagtcaggggagagtggcaactaaagacctgccattttcttagtgcctatgcaggctgagactttactttcatgagctcatttaatcttcacaatggtgactgatacagtcaatattataatcctcattttacagatgaggaaatagcagagatgcagcagagtcagagttcaaagctcggtcagatacaccagtgctttttcaaggacaggcttctccttctcaggttttggttactcttgttttcttttttcttttttgagacagagtctcgctctgttgcccaggctggagtgcaggggcgagatctcagttcactgcaacctccgcctcctgggttcaagtgattctcctccctcagcctccggagtagctgggataacaagcacgcgccaccatgaccacctaatttttgtatttttagtagagacagggtttcatcatgttggtcaggctgggctggaactcctgacctcaagtgatccacctgcctcggcctcctaaaatgctgggattacaggtgtgagccactgcgctcagctgagacagtgaccctctgagggtctcagcatatttaggcagagattgggggatggcggagggagctactgagtgacaggcaccctctgagagggagcctatctcaagcaatcaaaaaatatcaactatatgtagggactctttctcccttcaagagttacaattaaacttttcagaaatcaagatcaaggctatagatgataaaaattttattcctaaaggaatttatagacaagaaattgattgaaccttataataccccatgatggttcatgagaaacacgtgttcatatgattataccatgtttttaaatatggggaaataaagcacagagtaggtgaatgtgaatttagggacatcaaaatgtaatgacaaaaatcagctaggcttgttcttgaatccctcaaactgtaacttttggctgaacaaatgaattaagatatagctaatacagctgcagagcttggaaaagttacagttgctttgttaaagtatattgagttggagtaaaaagttctatttggaaagatttcaaaacccttcaatggcagcccaatcattccgaagctgaattaaatgtaaattgtgaattatctgcatacgtttatagtctattcattttaatatacatacggtggttgtgtactttaagaagataaaaagatgattcctgaggcatcattactgcatggcagagagacaaacttgaaaacaagtaattataataatgcaagtgttaaactgaagatacagagaaggaatacacatattccacagtcactggttccctttgggaacatcaggaaaaaacagaagaggaaagttttgagttgggtctggaagaatggaactttagcaggcagaaaaggagaagaaaattccaagtggtaagaaaaacacagttaaaatcatagaggcaagaaaatataagaggctagaaaaccatagttcagtgtggccagggtgcccacaatgcacaggagaagatagaaaagagattgtttatgcagcaatgagattggaaaggacctggctgccctctaaggagaagtttctattttatagcagcaggaatctaatagagacgttacacgaaggaatgacaagataatcgctctattttagaagattaactctggtagcaggagctgggatggctgggggtgtgaactgaaactgacgctgcataagaagagaatttacaagcccagtcaaagaatgaggaagaggacccaggtcagggaagaagcaagacaggcgatgagaataaaggctgcttcagaggtgaacactgtagaattgggggcaccaggtggctggaggcaggtgagaagaaaaggaagatgtaaagagaaaaatgaaggatgatgcctagtttctgatcctgagctctgtctggctttttttgcggggaagagatggagattaatgaattgtctttgggcatgtttagtttcaggtacttggaaatacaggcttgcagtttagaaaacaacttacagctgtagataaacatttacgaattatcaacatttgaggtagtggcaagtaaatgatgtttttatagaattatcatgtagttaagaagaaaacagttttaaatattggaccatgggccagcatttaagagaaagttaaggaaaaaaaaaagatttaagaaaaagacacacagaaagtcatgccactgagattttactatgagtcccaggcaaaggttttaagatgagtgtatcaatgtcccctaggcataaaaaggattaaaaagagaagagttcagatgacaatttggaaggcactggtaaactttgagcagtttaattagattggtggagagttggagacgagacagagtccttgaactgataaacaaaaaaaatctgagagtatttggtagtgaaagtaaaggaagggtcaaaagaaaggttttgttgttgttgttgttgttgttatggtttcttcgatagaaaggggaaagataatggttaattggggtaacccagcagtagagattggcagggcaggtaaaccggcaggataaaggaaggagagtatggattagattttaataaaagtttcttagggaagaggggaagaaggaaaaaaaatgagttgagaaaatatatattaaattctttacattgtgcttctgagacagagctatatttagcacccataataaatatatctgataagaatcctagtatgttgctgactctcagcactctgcttattattatgaaaataaaaatgacttccatgtcattctgtcagactatcttttggaaaaaacaacgacaacaaaaataaaaatgtcattcaatccgaaagcaagagaaaagacaccttagtaaaagtaactttcttcttccacctacaaaaccagaacttgaagacacaaatctcaggtgtactgaaataatttttttgtgcctggatataactgctttatgggatcacagagacttcagtacacactctgggacaaacagattattcacaaatgatgatccaaacatattctaggcattcaattgaataaggcccaggatcacccccagaatttttctctgggcgccaaagaatcctacatgctgaataagaccctaggcaagaccagagctccctgcaccatttgaattaggtagtttccatcttgcacctatgggaaagagttggagccaacccaatctttatgattaggcaggaaaaacaacattttccataagaatgtaatcttctgcatggttggtcaccagttatttgttggacatccatttggtttctgccaagttagctaattgttctgctaaatcatctttaaaagatgacttgccttcttgagttgttaatacttgtgaaattcttttcccaaatgaatgagaattgaaagacatagattcttttaacacacacatacacaaaattcccaaacatatagtgtgttgaaagttagtctgttgcaaagaaacttgagttctaggcccggatccaggggtggagatgactgtaacattccaccaagaacttcactcttggctttcacctcgaaactaaaaatccctagttaagtcagatatatgaagtattgcactctaacatgaggaggaactgaagaaaagggaggatgttttcataaagatttagtgaggaagttagaaggaattatgtgtgaaagaaggaaaaagagtaattgtggtattattacaatacatgcctgggccaggtacagaatatgatgggtccgtgtttcactccatacagccctgttatcatgatgacattatgaagtaatttcctatatactataatctgttttggaaatgctttctaccaggtgtctcttatggaacatacaggaaaaaaaaaaaaagagttgacctattaaattactctcgctgttcaaatatttgaagtactaattcatcactcatgacattcaatttatattttaacatcattataaatttaacagggttgaatctttcaaaataacaaagaaagtgccttttgaaaggaaagaagataggaacgttgaagaggttcttgtgggatcactcttaaaagccatcaaagcatctgaatctctctcttggctgtataataaatattcacagaaaatgaccgccaagtatgtatggagaaatgccttggcatttgctgtatgaatatggatgatgggaatatagtaaaatattagagagattaaatcgaaactcaaagatagttctaaggtgtttactgggtgtcacttgatgaaatgactctatggggatttatcactaatctgtgaagtgaaaaataatcttaatgacgagaggaagcttacctacattatgcctaggacaagaagtttttaattcccctctaacaatgcagtgtttgcaggttttcatccattatcactttgttagagtatctttgctaaaacccaactattttataggctcctctgacacctcacaagaatccaagggaggaaatgaagccaatgaatgtaatctacaggtgaaatttgcagagcaaattcaggaaaaaaaagtaattatgcttcttcgcattttatcattttataacctcaccttttagagaaggtattgagagattatactgattagtccagatttttattttacatatttgttcatggaaaggcttattttaacagaagttatatcaaggtgtcatgcccagtaccatcatcatcatcatcaaaaatttgactgaataaacctaagtacacacacacttctgtatgtatagtcttacatatgaaagtaatatttattcattcaccaaaaagtgtaaagagaggttaaaacaggatgggatgaaacagtgtacaaaggtaaggaaaagcttttccaagcaactgaatttcccttgaagcctgaatgttaagtggaattaggcaaagtgtggtggttgtgggaaaattcaggcagaggatatagctagtgcaaaggctctaaggctgcaaaggatgcaagctatgcaggcatggtgcaaggaggcctttgtgcaggaagcaaagggagataaggctggggtgacccacagcctccttcttcaagggcactggatagactcctgggaagcaaaaagtgactggattaaatttgcatttcaaaaagactcttctgactacagtatgtggcaagataattgggtgaagcaatagtccaggtggaaagctttattacagtcaaaacaaaaaaggatgaagacttggattggggtggtacttagtgaagaggcataaaagaagactgaagtcaaaatgacaggacttggggatgggtgggccacagaaagaaggtgtcaaaatgattgtcacagtaggtaattagtcattgattgatagaaaatggtaatcactgaactaggctttttatcttcattctgttctatttaggttcattctatccaaagtatttagtgcttaccagatgcaaagtacagttaggaattctaatggatagaaatataaaataaatggatacaaggttatataatctctgccttttataggcttatattcaaatacagacaatgctttccatttccagtaaagggaatgagaaattatatacccagatacatatatattgacacacaaataaacagatgtatacacatgtatgtctacatatgtatatatgtatgtacacatatgcatatataagtatatatatatttgcatcatatacacatctaaattaagggtgcattgccaggggactgaggaggataaataatgcagaggtcagaaaaaataactgaaaagttgtgtgggatggtattcttcttataagaaattcaaatgttttcaaaaatgattgtcttatatatctgccttattacagaagaaatgtatgacgttggccctgtttatcagggccagaagaagaaattcagcaatagtatttagcagtattaacaattttaatccatgatatcagtcatgacactacaatcctgacagtaatcttattaatagtaatgataaataatagtaatcattagtatgtagtaatttttaaaagtcacacaagcagaaaaacataaacatagatttgattttaatgttgtttgaacattgccttttagcatttttctttgaattctaagctcataattttatcataaaactgtctttacagcagacaatgactaattagtaattctattaaatatttgccaaatggagggtaccacttctagttttgccagagtgtcttgctggtcagaagtgctttgcctaataaactcaacatgcatgttgatgctaagagtctaactgaacacacaggacaatcgcaaatctgtgaattattaagcctcctttcacctcaatttcctccctcataggatggtctttgcttatctcagttttgtgtgtattccttttgattgcttgttaatgtctcctatttatagtgatattatgtaacagtattatttaatctccaaaatagtatacaattgtcaagtaccattgctgtaattatggtgcagatgttggaatatgcttggaatcactaaaagtgaatttaccataagctaaggaagcttactcttcagggactctgacttgcaagagcctatttaatttcttattacctaaatttgtaagtttaattttgcagtatttttcttttaaaagatcccccaaattttatgagcttcatttccagaaaactcatctggccttgtttttcatattgtattgtcatatttaatttgtttttatgcctttctcacaatattttaggttcatgagatcagagacagtattttatttgtttctctactgcctagcttattatttatttatttatttatttatttatttatttatttatttattgttatgagacagggtctcactgtcacccaggctggagtgcagtggcacatttatggcttactgcagcctcaacctcccagggctcaggtgatcctcccacctcaacctcccagtagctgggactacaggggagcaccactacacctggctaatttttgtatctttttttttttttttttttttttttgtagagacaggatttcctcatgttgcccaggctggtcttgaactcctgggctcaagcaatccactcatctcagcctctgaaagtgtaagaattacaggcatgagccaccatgcccggcctgtctatcacttagttcagtaaatgcttggtgaatgaatgaatcatatacatttagtggttgttttgaagttgactctgctgagtgagattttctttgcattcatgcatcttcattaatgtcaactttgttgcagtttttaaaaaagtaatctttgtttacattatcttaagttacttgatttaaaaaagttaaaagtgactatttgcagaattctaaagtcccattactgtcaacatgcataatattttgccaaaaatgcaatttgtcttgttagtcttctttaatttttccatgttttaaaacttttcttggagtatttcccaaatgggatttactgagaggatatattcagccagctttgtagattctaagagtccttctaaaagttaagtctagccaaggaaaaatgtagtggcacacgattgcgtttctcttacgctgtcatttaatgtgagatctaaattttgcatttctttaatgcccaaggtgtttattttttaaaatctgtactctttttatcaggagttatgttgacaatttacctgggagctgatataccctatataatacatgatctaagacctgaacaatacacaaattaataaaattaaaccattaagatatgtcatcatttctaaattatacaattgggttttttttttaaagcaaaaatattcttcctcttttctccatcccttgttctggtcagttccaaggttttttacaaatgcaaaagaaattcatttgctactcctgaccacagagatgaataatttaaggacaatatcaaattcttgataaatctcataaatgttttaactgtccaagaaatggacatttatttggttaatcttttagctggccataaataatgtaataaaaccccttaaaattaacattaaataacataaagacctaacgatttttagaaaaaaacctttttggactgagccttgaatttcctgagaattcagctacaagtgataactaaaatgtaactcgagaatctggatatggttccagaaaggattgttgtcatgcaattgccatttcatcatctttccttaaagtcccttcaatatttatcattgcaatttttgtcctgtcttttcccctccatcacatcaaaccaaggaaaaacaattattaaatgctcatttatactcacctccctcccttcatattcattcattcctcagccctaaaattcctgtaggaatcctgcttttacgttttatcttaaagccaccatagtatctgtaatctcttttgtagtcatgtatgcttaattttggaagactgtcaactacctcttcaggttcattcaaatgaaaatgtatcacaaaatcgtaggctcttcccctatctcactgaaaaattactctaaaaatgaccagtaagctgttttgttgaagcaaaacatccagaccctaaacaaaagtagcagaattacaacatttccatagaaatggattttgagcttcttttttttaattggggaaaatcttattttttaaaaaagaatcccagaatacatctttgctttcagtccttcaattctaacataatgccatgttagagaatatgtggtagtgtatactaagcccttatgctgtctcacatccttgggacaaaatatctgttttgaaaggacttctctgaattttgctatttcctgcttactgagcagtggccccctcctgggaaaacagagttatttcagccagtgttcagactccatcttgcatacgtctctgtggaatattaatagtgctactgagatatattcatcatcttttctctgcttttgctgtctttatagcccagtgaaatttatatttggtgtttgtaggaaggctatcagaagctacttggacatcaaacttttaaactataaataatgatggcaagactgctaggatatctttccacagttaaacccattcaacagagtttcgttcttatgacagtgcaaattaaactagaataaaattagtgtgattttaggacagttttaaagtgaacatatttccctccctcccttcccatctacatatcaaggagacactccagactgcacttttatttaaattgcggccatcagaaaataccgtgagaaggtagtgtgtaggtaatggttcagttagcattgaccccagaaaatggaaaaccaagagcaagtcacttttaaagtgaagcaatagattttgaatatggattgttccaactcaccacttcccgaccacaacacaagagtatttcactgtaaattaagagtctaagttaaccacagctgtggtataactctgagaatgttttctctacatgtagacaattctggatccttccgtggtgcccgttaccctggtctttaacttttgtcctttgcaggggaggggtcaatgccttcttatttccttgctctttagaattctccaccagagggaggacaagggaaggagtaggtttcacgcgcagttctgagtaaagtttgaatctgagaaaccccacattcacgaattaaggatctccagttctgtgtctttattctacccctccctgcctgcttttccactcggcagaactgagtgactttcagcggctgcagtaattttaattattctgagtcgtgctccgaactatgttttttatcagttcctctgaaaattaagttgtagtaagagacgtagtttaagggcacccccttagaagaggccaggttattttttaaggaaaagctgaagatttctaacaggcacttactaaacacacacacacacacacacacacacacacacacacgcacacggcgcagacccagcaggagagcgcaacctagcatctttaaggttcgcttagcccttcctgtgcacctggaaggaagccttatcttaaactcccttccacctagagtttattttcgcctgcgtgcgacagggcttttgtacttaagtgagttaaggaatgaaccccgaactcttctgggaaagccaccaacgttccccccgcacccctcccagggttcctgaccacggagactctgcttggggcacaggtgtgggagtcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtctaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttgkatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctggttgacatcsaktcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaacyttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactmttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattatttkgtgtctttctcttccccatcatagatttcctgtcatctctctgttaccctctacctctcagcgaccccaagctgcctgtwgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcaragagcccacgctcttaaaaacaatacattcctgtttgcattgmgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtaraaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaaraaaaaaatgccctttgaaaaacacttcaactaaattctataattttgtcatctgaggaaatcaggaaaacaaagaaacwtctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaaraaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcascatattcagcacattatgcacagagctgtagccttcaaggtcwtagactgttgaaggctaattgattcttctttatcctggagcctgagagagtagaagagagacaatcccagtaattgtgtctgcagcgttgctccccaaaccaatctaccwactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggcyaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtatwgactcttttttatttttgtaattatgtcattttggctttataggtcagtatttcattgcatcatatcaaaataatttcaactrtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaaygtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcarattattaactatatttacttctgaagtctcttacaactctggttctctcagtttattgtctcagggtgttagctttccagtgggtaracttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctytgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccarccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtatkttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgsttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacamttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcrttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaaygctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaacmagaaatcatatactatcttagcaggcrtatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcytgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacrgctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgwacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctcttwacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctytacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatkaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagakgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaargtacagtaaaaatacagtattataatcttatgggaccactgtcrtagatgcagtttcctgttgaccaaaatgtccttatatggcacgtgatggtatatgccatattttgtttawctcttcttgcatcagtgaacacttgggttacttccacctcttaaccggttaataatactgatatgaacatgggtataacattctaattawgttttgttcatctgtggtgggtgtgaaagttaaaccaatggaacctttttttagtgaatttagtcaaatttctgaaaamcaagaattcctatggaaacatactgataaacatacttttcttattatatattaaaaatgcttgtagggaaaacccagcttctaatagtactctgggtttgtgaagatgcagtaagtgcttgctaragagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatarataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccscatctctgctaaagayacaaaaattagccaggtgtaatggtgggtgcctgtagtcccagctacttgagaggctgaggcaggagaatcacttgaacctgggaggtrgaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagawtcctattgttttcagcaaataggagtttccttctctgtaagcattgctgactcaagactatataatgttagaaatagaaaaaagatragaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccasttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttmatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatgrtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcakggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagaygtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggargcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccargaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcrcatcagagagccttcataacaaatgagaggartggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttscacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtktttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaamtagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaataatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcrtataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcrgtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgaygaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattsgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacraagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaaytgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggaggtcagtatcacaacacarccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcrtgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgrcactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatrttactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacttgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacrtggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttattwgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggmaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgatamcagcatcttttacacagtgatgaattaataattaaaccaaacaaaaccaaacaacaaaacagttttacagctacttgggaaatatctgtaaacaaagtttcmtaataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaarttgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatyttggaggagacgttttgcagacaaagcccaactmttttccytccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccasgctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgaccaaagtatggaatttcacatacatgtcatgataatgtcctagtcagattcagtcctacctcttgcttctgaaaatgtgctagcttctgttctaatcctaattgcatgaattagttcattgtccagtttagaaragaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatasagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctytaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaaragactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacaccyggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaaygtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttgggsatggtggcgcatatctgtaatcccagctactgaggaggctgaggcagaagaatcgcttgkacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgtkggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaawacaatataatcyatcttttttttttttttttttttttgacacagagtcgtgctcttgttgcccaggctggagtgcaatggcgcaatcttgactcaytacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactyttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatactwgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttastacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccamtgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcytgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataatttyggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttktcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttggggcatttgtrttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgwgtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattwagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattygagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggamtacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcartttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtmattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattamtcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaarttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggamtatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagttttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcrtttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcarttctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctytttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtaratattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattytcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgamcaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatattttggattcaagatggactactgctatcaattgattagattgaaaacaagcaagcaagaatctagacracacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaamtcctgtgctyttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtmtcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtyttgaaytccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacrtattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcrggggaagacctcagtcattctgagttattacagctccaggagatggaagtgttttattagcccatatatatatagatagatacagtgctaccaggaaaaaactaatgaattataactaaggtcctwtgtatggaccttaatattccttgtgtctgacgatgcaggaatttagccaggcaagctgagataaggccctaacctttgctctacttttctttttatgatcttyttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcrgcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctgggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaarggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaaytgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtraggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttaytaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctrgttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcmaatggcgtagagttatttggtttaattttctgtaagtaactcgtaaagaattgtcctaaaagctgtgggtgaggactaattcattcaagggaaacaggatctaatgattgcyttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatctcatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggaktccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaattttttttttttttttttttttttttttgaracagagtttctctctgtcacccaggcttsagtgcggcagtgcaatctcggctcactgcaaccaccacctcccaggttcaagcgattctcctgcctcaacctcctgagtagttgggattacaggggcacgccaccatgcttagctaatttttgtatttttagtaragacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctyttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgaragctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacacygtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgarctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcawacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgsgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgycttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccaraaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcmttccwttttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgaratggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttrtcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtaracactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctratcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtacgacaatcttcccttttttttttttttttttgagatggagtctcgttctgtcacccaggctggtatgaagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggargacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctctttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgtygtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcraggttagtcagcttcaaatttgacctaacttgacacagaattcctagttgaaaaaaattgtgttcatcsatatgtggtgtgtggggggtgtgtgtgtgttcrtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctgrctagttaacgagaatacagtaaatggcccagggtacatctcttgatgtgtytgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacacagagagagagagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctwtctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaaccmttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggargcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttmttcccacccaagcatttcctccctctggttttcttttctttctttatttttcctcccttagtatcaggcatgctgtgccagggacttcagatggctccttaacttttaacctwgttttcccttcctcggtctctctgtcattctgtcagtctgtckgtcctcttggtttgtttttcctttccacctccaacccttttgatttgtttttgtatactctatgcagcattctagtcctttacccackgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagasagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataawactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcaragacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatacgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatttttgctaaaaatacaaaaattagctgggcatggtggcatatgcctgtaatcccaactaatcgggagggtgaggcaggagaattgcttgaaccgggaggtggaggttgcagtgagctgagattgcaccaatgctttccagcctgggcaacagagtgagactccatctcaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttgggatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtgaacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctgcgtctggcagtcttcacgggtggttttcaaagcagatactgccttcaagatggccctttattccagaatgttttggctttcctttggggagattgggttgggttgggggagttatagcaaaggtaaaatgaagaatggaggaaagtaaacaaagagatattaaatagtaatattgaattcatagattctctttctccattttcacctgagctggaagatgaccagtatttctagcccatcagtaagctgttacctgttcctatttgtttgcaagtctgctgggttttactttattttattgtcatctcaggctaatctttgaccatttactaaaaggtttacataatgtcaaatccatacttatgtggtagttacatgggaggagatgactttgatagagtctttccactcttggactgggaagttacttccaataaaataacacattctgggcttgaaggcctgttgcttacttttgcaagggcctttccttcaaaatgatattttagaactttgtggaatttatgaaatcagaggtaagctattacctgtttgtttgcaagtccgctgaattttattttattttattttattttattttattttattttattttattttattttattgtcatcttagtctaatccttgaccatttactaaaaggtttacataatgtcaaattcatacttgtgtggtagttccatgggtagggatgactttcatagactcttcccactcatggactggggagtacttacaataaaaaatgacaggctgggcacggtggctcacgcctctaatcccagcactttgggaggctgaggtgggtagatcacgaggtcaggagatcaagaccatcctggccaacatggtgaaaccccatctctactaaaaatacaaaaattagctgggtatggtggtgctgccctgtagtcccagctactagggaggctgaggcaggagaattgcttgaacccaggaggtggaggctgcagtgagctgagatggtgccactgtactccagcctaggcaacagagcaagactccgcctcaaaaaaaaaaaaaaaaaaaaaaacattctggacttgcaagcctgttggttacttcttcaagggcctttccccaaaaatgatattttagaacgttatggaatttatgaaatcagaggtttccctgcaaccaatctatgaaaaagtaggcagggtttaaactgttttaaaactttagtcttaaattcatatttttttaatgtattaaggaagtctatccattctgtttcaatcgttttttgaaacatgaaaaggaagttagagatgaaatcattcttcatcactacaagtgatatttatccttaaatgttgacatttccccactgtgctgggcttctagatgatatctaggactacgaaatattcctgaacctagagattatggagagaaaagatgaatcacttttatatgttggttgaatttaaattagcatttctcagagagcttaatttaagtacccccaaagccaaaagtttgaaggctcaaggcccacatatttcaatttctcaggcacgttcccagtttagaggcagctagctctcacgtctgtatcactgtgactccgggagaagcagggaggttcatacgttttccgttcctgttagcaagagttcagatgatggcattccatgtcatttcaggtcacgtcaaattagactctgtgaatgccagtgtgaagaaaagagtcatttagtgttgtgcgttggtaacattttttatcaaaagctgagaaatgtgactctgaataagccacgtcttcctcagtgccaaaagtcaggacttcttatactgggggaagaaagcatggtgtggtgaaaacagtgtgctcggtggcctaatggcaagagtcactgagcattatcagacataacatgatagaaggtaacagggtacagccaacccttgaggcatcatgaaagagattgaccaaagactgatatagctgtgggttttggaagagagatagaccaaagattggacataacctccattgtggtaactgtgaagccaaattaggttctctcaggcttacctttgactgtgtttgttggacactgggatggatagttccaaattgaatgttaactagttgcatttcatggaaaaaatgaaaagcacacaaatgtatgacactgttgtcaggaataaatctaagttactatgctctttttttttcataagacataaccttatagctgagctaaggagaaacaaggcacacagatccaaatgcatgcagatccagctatcagcaactcatcttagatcttcttccattccccatttgggcttcattctctaagaccccttggcctttaggaaggtatagtatttaagtaatacttctttcccttccgaatccctgagccttggtccttatataagctgagaggtttccaggacctaatgccttcttgtcttggctcatatgccattatttataattgtgatgagattgaaaatcccaaaagctttgatgagctaggcaatttagctgatctttgcatgcactcctgtgaggaaactcttggctacctaattttcgattccaagggtgtggaatttcctagcctaaataattaagcagcctacaatgaatagaaattctctgttctctgatgatataataccgtgaactctgtccccttaccttccctgctatgtgcctcttattgcaccacacttatgcagggtattctgtgctcacacaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcactgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggagcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggagacctgggagtgttgctcagcagactacagcttcagtctgttagaccagcacctttcatctcattcccatagttatgctaatttaggattgtgttccatggaccccatgatcaccttgtctatacgttgcttcttgtctgtccattgcttttgccacaccacctgttctcaaatcatctcctccctaccaatgctgtttatcactttcttccttgttgaagaggccacacaaccagacagtactatgcttcctttttcctccatacacaataacagagagagaatattctagggcatgactgcctggatcctggctgttgctatcttttgtagtggcagtaagaaactccttcagactaatgaaaatgtcaacgtgccattcaatcacgaaaggtaacgaaaaatgctctcatggttcaaatagtccaatggcccatagtggcctaaaaggcagccagttgacacctggccatgctaagcttccttataccatccgctaatgactttccattgggcccacaatttacggattcataattttaaaagaggagaaggccaagttaggttcattccccttattctgtcaataaaacaaatcaaactcatgtctatctaactgctcagggaggagcctttgcatgagaaaattctcatattctaagactgagtcatagaaatgagggtattacttttcttactgcaattaacctaaacaaaagccatattttaacaaatagatatttgcatggtacccttcatatattccaagcatttcactcattattccaggtaggttaagagcttctgaagtgtatgaagtaaaggtcagcaatcctttggggtgaacagtggcctcctttggagtttgggggtaacctgagacttcccaccaatgtccacctccatctgtgtacctaattcctattacctagttatggctcctctaggatcatttccaaacactctggatgtccaggaaatttaaattgtagcttttgactgagctagtttttcctatttatattaataaattttcaaaaatgcttgaaatcttcacatttgcaacaactttagttttcatgcacatacaaacacagagagacaaaaattccaaacagacactctccaaaagccaccacactctttcacttgctctatagtcatttagccaaccagccatgcagagaatatttaaaacttaaagattgagacattattctcagtttttgctgaggctttgtaacgaaattgaacactataagcagctattgtagtaattttggttaaaattgtttgcctgggatatagtatttgaggcagaagcacgtgtgtgaaggaggtgaggtggtttggaaagagtgaagactcgcagccagattgaatgtctggataattactataattctcccttcttggttgaaaccatgttctctcttgatttttaaacccaggctgcctctggaaacaagcaaacctgagtctttctaacctgagtcttcccaatcattagatttcttttctgtcctaacgatgaatgataaaaggacttgatgttcacaatttggggttataaggcaggtctgaaatctggagactcaagatgctggaaggagtggaaagtttcgatgactttatatgaatcactttgcactctatgtttggcttgtcctctttgaaactgatttactaaaataaatgtaagggaactattactccaaaagattaacttggcaggaaataccaatactttcagtttatgaaagacaaaactgtcttgttgctacaggaagctgcaatattcctaacctttaaggttggtgttgaatagggtggtcatgccctcccctgcaggtatctttaggctcctgttgacctcctggtactataactgttcgtcttctctgggtagctattgattttgaactttaacatgcttcaaaactttattcatcagggaaataggaaaagagttttgttacctggaggaaatctattgtgatctacctgagctttttaaaaacagaccaggagaaggaaaccagtaatttttaaagaagagacagagaatgggataatagtttcacccaggatctctttctaaccctttcccttcaaatgaacttattggaacagaattggaaagaagaaaggacatctctgcccaccccacaggatgccaaaaaggctaaagaattacctctgtagatttaaacatctttaatggcttatgtatagatttgctaatacagagagaaatgaactattaaataaaaatcacattttataatatttttatggcttaaaacatcctttatctcctttttgttctctctacatgatatggtaagtgatgaggaaaatttaggctcaggaaggttaaaatctttcttggagttacacatctaagagagctgcagagctgacacttgtacccaggttttctgactgcaaatccagtttctttctattgcgttcttcccctttccctgcctcaagcagaaacaggttttttattttcaacctttgtgtatacagtatgttatgttacatctacagctaagtttctttttagaagaatgtgagcccttctagctttggtttagagtgattctagaagccaatttccttggcttagtgattctatgcacctttcctaaacttagctttctaaggaaatgaagtgtacgagtgagaatgaattcacaatttcgacatgtaggtagcatcctaaagtgaaaagaggaggaaatttgtggtcaaagcactctccccaccacttagaaacttactgactgtgggcagcttcctcctccaagtttccttcctgatttacaagaccgtggtgtggtcaggattaaacttgaatacatgtaaggaagcctgaaagtgtctaacacatagcgagtattcaaatgccaccttctatttgatccttcccctccagttccttaagttttggaatctaggtttctcagttccaaatggattgacatttgcatatccccattgcacaatggatcaaataaactttatgttatcatttctccaacatagtgccagtaagcaaatcctttttaataacaacagtatgttgagaaacatatcaccaaataatatttaactttgtagctttgataagttctttaggttttggttttggttttgttttctgagacagggtcttgatctgtcacccagactggagtgcaatggttcaattttagctcactgcaacctgtaactcctgagctcaagtgatcctcccacctcagcctctcaagtagctgggactacaggtgtgctccaccatgcccagcgatttttttttttttttttttttggtagggacaaggtctcgctatgttgcccaggctggtcttcaattcctggccttaagtgatcctcctgcctcggcctcccaaagtgctggaattacaggcatgagccaccacccataactttatgtttgtttttttgatgcagtataagttcagcttgcttcttatgcagccataccatttcatgttaactctgatttttagcagcttattacattagtgttttattattaatataattttacagaaatttactaaaccatgactctgtagagttttaataatactacctccaaacatcattgcaaacatctagaagaatgaacaaaaatgatcttagatcgacagtatatctgtttgtcttagtttctacacacgatgttcagacatattccatttctttaaaaaaaaaaaaaaaaaaatatatatatatatatatatataggcctggcacggtggctcatgactgtaatcccagcactttgggaggcttaggcaggcaaatcacctgaggtcaggactttgagactggcctgaccaacatggtgaaacctcgtctctattaaaattacaaaaattagccgggcgtggtggcacatgcctgtaatcccagctactcgggaggctgaggcaggagaatcacttgaacctgggaggcagaggttgcagtgagttgagatcacgccattgcactccagccttggtgacaagagtgaaactccgtctcaaaaaaaaaaaaaaaaatatatatatatatatataaaatcccaccaaaagtctgcagagtgaccaaattagagggctctggtttcagattaaattctaaatgtgagaaaccacatagctcccatgatccatccaataattcctcacgtcctcttcactctttactccatgcataaaacagaatttttttttctcatcctgggtatgaagcaattaataatttacggatttagcctatttggattcaatcccttcaaactccatactacatccaaggtggaagtgacttaaactctgatatcaatcatcaggcttgtaatataggctttgttaatggcaggagagtctaataaaactttctgttccttatccttcatttaaatgaaaaactttttattgaaaacaatcataactctagctcatcataaatataattcatgaggacattttattatttttatattaaagaaataatattatagatgtaaactttgcacctttctaattattatcatgagttaagctaatacttgtcttctggtccctagatgatgattcttttttgccttactggaggagcccttgtcttgaagtgagttgcttcaacagcagaggacttctagtttctcccagttgagcctaaagtgaacttttcatcttcttcagaggaaggggcttccttgatttgtacttttgtggctcctcagataacacagacaattttatcttggatcccaggttctcttcaccattaagaataagaaagagagaaaatgctgtgcatgacagccacctactccaaactacccaaccccctgtaaccaggtaccttccaacaacgagatgattctgccctcactcaagagtctcccccacaaagattccattctccctttactttttattttttatttttttgcaaaacaaaggcctcctttagtacctccttagtttataacccttatcttcccagctcttcccttcactgatacctctgatttcaaaagttctgaagtcggaagaccacacaatttcagactgtgaacagaaattcagtcagaaattattggagttagaaagaatttagagaaattgtattgaactagaaagtcctctttgattagtggtggccctttagaaagttctagggcagagtcccatggtgtttcatcttttccatgatttgcttgaccaaaaacttctctttcacaacatgaaaatatgctaatccaccacacattttggattctgctctgtttgcctgaggtgttagatctctagccaggactgtgaagggaaggaacttgaatccttcctattgagctattaatgcagagtcagtgagatgaagggttccactcggggtcaaaatcatgtcagttaccaagcaaaggagcaagtaaggggaaacatctcctcatctggttagtggagccacatttcacccactgatcaagccagacctgagcaatagtctagatttctccctccacatctaattggtgacaatggtgattgtaccactgacaggtcacacaagtccacaccctccttcacagcctcactgcttcggctcttgtttatgctcttatcagcatctgtcactgggatccatttctctcctgactcatctacttcctttcactcccctgggccatccttcacatcatgctagaagactgtgtctaacttgcagaacttattgtgtcaatctcctggttacggcccctccatggctccccacctgacataggagacccttcacaatctggcttctgtcactcataacttgtctccagccttcattcttcagtctgattttatggttttctagttccccaatacaccacaccagtgtttatgaaaccctagtcattggcctacgaactttatgattattgacatattcatgtaccacctgtattattttttgcatagtgtttatttttaattgactacatttttaactacaataaagtaatttcaactaaaacttggtatcaatgctgcgaatggaaaactgctatcagttgccataataaaaatgaaactgtaaaaataaatataataaaaatgaaacaaagttattaagttctaaccagatactgttgcctgctcaaaggtctgagcaataagcctgttctctgtttgacacaaagggagttcagaaagtgttagagagatagaaaatattttggggaagcacagaaagatttattccctgagttagccaggattgagagggagttgatagagcagttacttctatggttttgttcaatgttatttaatgcttgatcctagaatcatcctgcatacaacattcagtcatccacatatctcaggaagcacaatattgtgcttgctacatatccctgcccttgttctgttttactggaactcccttctccattcgtcctcctgacaaacttctttcgccctctctctggataaagagagtttccttctctgggattccttccatgacctatttccaagtttccaggccttgagtgttccttcattgctatctcatagcacgccatacactctccaacacagcattttccatctatctcagaacttgtagttaactgcaactcctccctcagcagaccatccgttcattgaggacagacaaagacactgtcttatttgtgtatgcccactgcctaagacagtgcctggaacgttgtagacactggacatctacagaatgtatccctggcagcgagagactcagttgccataggttggcaagcacatgaggaatctaggggatcatagtgacctttaaagctaagatcaagaaaagagtaacctgtaaattgttacaacaaaatcagaaatgtaggagtagaaccaagcttgctaagtcatggtcaaaaacactataggtcagagttcaaggaatggaggcttcaaagtttagactagattttgcagtgaatgcatgagtactaaatatacctttacgcttgtcttggctccctctccacccaggaacccaagattaaaattaacccttcatttctcttcttcctccttccatcccctctcgcatcttctcaaggtctcaaaaataaagccctctagttgagcattcttcactaggtcaggttgtttttttttctcaacttttattttagattcagaggatacatgtgcaggtttgtttacatgggtacattgtgtgatgctgaggtttgggctacgaatgatgccattcactaggtagcgaacataatacccaacagacagtttttcaaccctttcaccccctagtagtccccagggcctattgttcccatctttatgtccatgagtacccaatgtttagctcccacttataagtgagaacatgcagtatttggctttctgttcctgcattaaagcccttaggataacggcctccagctacatccatgttgcttcaaaggacatgattttgttctttttttaatagctgtgtagtattccatggtatatatgtaccacatttaggtcagccttataaagaagatttccttattgaccgtagcatcaaacccaacctaagtgctcagtcctttgaagaggtacaaagatatccttgcatagaacaagcccacaagttttccagatgtgtgggttgagtaaaacatatgaaatgaacatgccgtataaatcagtgaaatatgtaatttgttattctggatagaatgctgatttgcaagactaagtgttcagggatattttctaggtaattccacttcatacgtaggcacagtataactatttgcaagggagaggaagggcacctaatattaccacagaagtcttcttttcccaatagtttgccagcctgaaaatgtagtcttctttattgattaaaaaaatctgtcaaattgtcaacttaaatgtaaggctttttgtttattggtttacctagtgattctaaagctaactccaaatttagttacccaaagattaaaagaatatagccgtgtggtttttttaagctttcctgtccaatatacaaacccagtttgccacctgctcatcaatggaattttatgtaactttcaactttaaagataattggataggaaatacctacagagctttttgaaaatttcagtgaaacggcatgtccctggcatggagttgatcacacctgcaatccctgccaatctgtgcttgtcagactcagaattagtctcctaggctgcctattcagtgatgcctgaaggtgcccacacctgggatagcagataccacactgctcgtgaccttctaaattccccacctaaagggcagcaggttgacaaccaggttgatagggttaagttttgtgttgccacccaaatctcatcttgaattataatccccaggtgttgagggaaagacctggagggaagtgattggattatgggggtgggggcagtttcccccaggctgttctcatggtagtgagtgatttctcacgaaatctgatggttttataaggggctctcctcccttcactcctcactctgctctcctcccaccttgtggagtaggctgtgtttacttccccttctaccgtgattgtatgttccccgacacctccccagccatgtggaatggtgagccaattagacctctttcctttataaattacccagtctccagtagttctttggattagtgtgagaatggattaatacagtgaattggtaccgcagagagtggggtactgctataaagaagatacttgaaaaggtgtaagcaacttcagaacggggtaacgggcagaggttggaacggtttggagaactcagaagaagacatgtgggagagcttagaacttcctagcgacttgtagaatggttttggcgaaaatgatgatagtgatatgtgcccggcaaggtgtcatagccccagcactgggaagtggttgacacgcgggttggtagaaagaatttaccaacaacagtataggattgaaaaaggaaagtttattagaaaggaagaatgctacaaaagggtgcagcggagcacctcagtgggaggactgagtgtaccacggtggattttttctgaggagcatttatggaccttaaggtagaagcttagggttatgaaatgagttttggcatggcattccagagatgcagagaaattttaattattatactcatccaagttgaaagaggcctggaaccagatgctgactttagatactagggaagtttaattacttcttacttttctagataaggagttttgcctctggatggtctgtttaatagttaccaggtggtatttgctcccttctaaattcctcagacaaggagtttttttctctggggcttgttcaatagtctccaggtgattttgctctcctcattttccctctgacaaatattttggtcaaatctttgaccctttatattcccccatgcctcatgtctacctgctgcctattggggtctcaagaaagggaaaacaccatagtgaagaggggcatcgagtctgtctggctacttgctgctgaaaggggagcactgaaggagataggttgtgtttttccctttcttgttctctgtcacgaaagcaattaagggtcatgaaaaactcgttcaagggtgggggatggggagaaactagattccatcaagaggccccacataaatggaagttactgttgtaggctggtattgggattgcatagtcacctgtaggtggaatctctgtaatctggaagatacaaacttagtaaaagcagtaaaaagtaaggaccaaatatcaaaagaatgacaaggaacaaaggtccaaggaatggaagaagccaagtgatttttggaaaccaatcagtaacaggtttgatccactcttggttactttgataaagtgtatgtaaccatctggcttgtttgaaaatgtcttgaacatcagtctccacttctccagacacattaatgtaggtgcaacaggttttgttgatgacagcacagtctcctcctcattcagctaggaggaaacacagagcttgtctattatcaaaaaccattcctgctagtgagtctaaagacttttgtatcgctgatatacttgcaccaatttttgctaaggctatttcaagggagatggtaagttctagtagtatgattttatggtaagtaaaacctgcccgaggagcaagagttgcaatagtttctacaactctggccacaatatgttctaggcccctttgtcctcttgaatgaaattctgagttggaagttatgttcaggacagcgatttaggtgggagctattgttcctagagtacaatcaccataatgaagagaatgatcaaggtgggtaatattgttagcctttgtgtccccacccacatctcatcttgaattgtaatccctgggcgtttagggagagaagacctggtgagaagtgattggattgtgggaacggttttccccatgctgttctcatgataatgagtgagttttcatgagctctgatggttttataaggggctcttccacttttgcttgccacctgccgcttcgtgaacaaggtgccttactttaccttacaccatgattgtaagtttcctgaggcctccccagacatggaaaactgagtcaaattaaacctttttcctttataaattatccagtctctgatagttctttatagcagtgtgagaacgagccaatacacaggtattgaaatatgaacaacccaggggcttgtacatggttaaatctataaagccggaacatctgtgctccaaagccaggtcagtgctttatttatcttataaactcacagtccaaaagattcatagagagatcctgcctctacaaaaaatttaaaaattagccagtcatggtggtgtgatggattcctcttggtggaatctagtgatgggcctgtggtccaagctactcaggaggatgaagtgggagggtcacttgagcctaggaggtagaagctgcaacgaaccatgatcacatcactgcactccaacctgggcaacagagtgaaaccctgcctcaaaaaacaaacaaaagattcagaataaaccacttagattagtataactcttttctttgaattcacaaattgaggatgtaaaatgatcttgtccacaattactcagccaataaaatgaagacctgaagaggagctgacagctcctcagctattattaggccatgtggctagtcatctttaaagcccctgaagaaaatccagagagtagtaacttcctgctctttcttgctgatactcatgtgtcagcattccatgttggaagctgacaaacattgtgcagctttctctagaatttgcctatgttatggtaaaaggaaaatatggtataaagaacacgagctctgagaccagtgagatctaggcttacatccttcctctttcacttggacaatttgggcaaatttacatccttgagcttcagattcactgtagggtttacatttgatcatttttttatgcaagctttagtacagaatgccatatagtaggtgctcaataaatactatgtcctcctttggggcaattttcttgtgtaggaacactagcttgtctggcaaagagaaagggataggcactgttcctgagcttagcagcctcactgattatggctggtcctgcccttcaagctcccctggggaagccaggcaagaatgtgtgtcatcaggaagctggggtccaggctctgctgccaggatggaggcccattttattccccctgctacctcaaaacataagagtacaaacttactcagaaccgagttagcccagtagaacagatgtttcattttccttgagaacaaaacaattttatgaattcagaaatggaaataatagtttgcttcatctaattagcaggagctaatttagatttcaaggtcattgtgtacggtgtcctcctccttcacatgcccagcactttggctctactccctccctgcttctgtgattcagcatccatgcacacaccataaacaatcacaatttccattttaggatttggtctcctggtgctgtgctacagcccccgtttttaggaaattggtgcttggcaaacgatgaaaagtttcacagaatatgaaggttatggcacagttttctcctgcctcatggcttaatttaattaagtattctgtaatagctctgcagcagacttgtgctgcggaatgggctccaatttgccctatggcaactgcaggagcagagcaactataagatatgcaagatgactcatcagctgttggaaaatgcagtgaaacctttgccttttcaacaggatcaggcaaggggactgagacagcatccctgggaatagacacctggtaactcagcatctacaagatcattttaaaacatgcttacagtagagtaatcagcaaaaccactgtctgaccttgaaattattctatggctgctggaccttgaagacactgatggaagcagctaagtccagctgtctggaactttgatcaactatgtctgcccccctcagtgtagccaagacctcccttacagcaggttctctagggcaggaggtgtaagcagagaagtcaggagaccaagatgctctttcttattgtggcagataccgagtaacctcatgcctttgcaggctttcggctgtgagcaaattctgatatttattatccttactggggacactcagcttcacagattttgtttttcaaacatgaaaaaagaaaaaatcgaggccctgaagtcacagaatgttttggcagctatgttcaggcttgatagaaaggcatccccatggggacgtagcttttgtctggttccgtttaatttgctatcttcagaagggaaagatggagagataaccggttgggtggggctatgtgatggagattttctgttaagatggaaatgaggggagctttaggtaagtgacagatgacttcccaagaaactgcatgtaactagtcatgaacaacgttgcaatctaagacacaagtgacagaggtggcctaggaggcaatgctcacatgtagtcagtttgtacagccatattcccttgcaaggttgtaaaggggaccactctgtattactgctcatagccatggctacgctgtctgcctattagatgtttaagattttttttttttttttttttttttttttttttgagacggagtctcgctctgtcatccaggctggagtacagtggcaccatctcggctcactgcaagctctgcctcccggattcacgacattctcctgcctcagcctcccaagtagctgggactacaggcgcccgccaccatgcccggctaatttttttgtatttttagtagagacggggtttcaccgtgttatccaggatggtctcgatctcctgacctcgtgatccgcccgcctcagcctcccaaagtgctgggattacaggcttgagccaccgcacccggccaagatgtttaagaattaatctccagcatttcctgcagcccttccaaaattgatcctccaagaagattcatgcaaacctcattcatttactcaaagctcattctttcattcaacaaacttacactgagtatgtgtgataggcacaacactgggctaagagtcggggatgcaaagagtaaaatgtaaaatgtatcttatttaaactcatctaatccttctaagagaatacattctagtgctggagattgacacataaactacagcaatgtgttctggatactgacacataaactacagctgaggaggttgtgcttccgtgaaaagaacataagatttagaatccttagtcctatgtttattaccaacttcacccataggtgcatgtaaacctaaccttgacatattactaaacatcttggagcctagtttatctacctataagagttgaacaatcttaaaaggatattgtgatggttaggatatataaatatatatatcagtgtatatatataatgatcatatcttatatatatcacatataaataggattatgaaggttatggcacagttttctcctggcttaaggcttactttaattagatattctgtaatagctcagcagcagaattgcactgcagatatatatatacataaatataatattaggttggtgcaaaagtaatcacagcaaaactggccatgtgaatatatataacagagcaattgctcagttaatagttttaatgaaaatttaaaggtccagtgatgataatatcacaaagtgccacaaaagcacagaagaggcaactactgtctgagggttataatttcgctaggtttgaaaagaattgttgctcacccaaccaagaatggggtaaatgttattaccgcaaattatttttcatgagaaaatgcccagagaagtggaagagcagggtcttttcaagtaggtgtggtggtaggtagaattagaagtggattcaaatatagggctgatgtagctaactgggactaaattttggagtaagttcattgtgtccaccctggaggcaattaataagcatgttcagaaatgggatttataaaattgattctggagaccaggatgctaaggcaatggagtagagagggagtgggagagagcaagatggaatttagaaggtgaaggtaatgttgtacatgagtgatgatggcctgaatctaatatggattcgtggcaaagaagatggagagtagaaaatggagtggggaggaatttatgaggtggagagaaagccctgatgactaagtggacgtgtggtatgaggtggtagaggatccaaggatgtcattgagcctgggctttggaaaggttgccaacatctattctaagaagttggagaaaacactcttcatgcacttatagaagtccaagaggtaggggctgagacaagcccaacaccctattcattggctcagtcagatcctgatagtagctgtgggctattcatgttgtactgtgctagcattgcatggatatcatcacctaatctttagagcaatgctatgaaacaggtattatcattctcatactattcatgaggaaactgaggctcagctgtgttaggaatctaattgcatacaacgagcaacccttggagttggaaatcaaccgagatttgcctgataccaaaggccctgatcttcaccacttccctctatctgttcctcctatagagatgtctaccacataggactcataaagaggatcacctttttaagtgaagctcatgcctctccaccatcatagattatttcccttggtgtaacatgggagaacaaattctgactgaagccaggttgtctctctctttttaaaattacttatttatttttaatttttaatttttgtgggtacatagtaggtgtatatatttctcttttaagttatttataatagcaacatttgacgtagggataaaactcactgtccccattatctgtattcattcattcactcatttaccagccaccatcagttggtagcattccaccaatgctttctgctctcctggcactgtgccaggctctgtgtccactatttcaagatttatttttttaatttttatttatttatttttcagacagactcatgctgttgcctacgctggagtgcagtggcatgatctcagtctactgcaacctccacctcccaggtcccagtgattctcatgcttcagcctcccgagtagctgggactacaggtgtttaccaccacaccaggataattttttgtatttttggtagagacggggttttcctatcttggacaggttggtcttgaactcctggcctcaagtgatctgcctaccttggcctcccaaagtgctgggattacaggtgtgagccaccgcgcccagcttgaagatttctaaggtgtttctggaaagttaccctgctgactgtcctcatcttaccatcttttatggaaaaacatttccctcttggcattctgggagttcatagaggaatgaaacctttccatgttcctccatttctgacattgttggaaacgttgcaggttttatgttttgttttgttttgagacagagtttctctcttcttgcacaggctggagtgcaatggcatgatctcggctcaccgcaacctccacctcctgggttcaatatattctcctgcctcagcctcccaaatagctgggattacaggcatgcgctgccacgcccagctaattttgtatttttagcagagacggggtttctccatgttggtcaggatggtcttgaactcccaacctcaggtgatctgcccacctcagcctcccaaagtgctgggattacaggcgtgagccaccatgcccggtaggtcatttttaacttaacatttgaggagctgtgttgacacatgtcctacccatcagtcttcagggaaattaaggttttaatttcaatccagcctaaacaggtagtggtaaactctccacatcagggaggaccaggctggcctgccagtgggttaggatgcttcaggtgtgactgtttcatctacggaatatggtggtttgcagaataagtgttactggatagttctggtcacccagatactcatgcctactttgcaaattagatttactcccaaagtgagcgtactaatggaaagcagtttgtatggctatcaaaatacagtcactactacagacaacagggtaagcctgcccatcatgaatgaaaaatcacagacctcagagttgaagatcagagggtagctaaaactttcttcactctaaattgatagaatttttctacaaaaatcagatcattgcttttctcttaggttttcaaattatctgttgcagcatgcaccacattatattatattcacatttatggctgacttccagctagttgtgagctcatagattttagagattatgctgggttcacctttagccctaatgcttagcactatgcctggaacttagaggatcttaataaatatcattcagagctactactttatttatcattgttaacagggaagatcataggactctacagaaaaaaaaaaaaaacaaaatcttaattcattcaaggtccttctctgtactagtcttaaccaagatgaatggtaaaagaatatgtttgcagcagggtggagtggatagttttataaatgaagatggattataatattatgatactgttgttttattatatatctatcataaaagaaaataatcttactaaagaataatctttggtcctttcaattaatgtaatggagactctcaatttagctggaagagagattcagtcttgcctgggcatgtctctggaattggtgggagcagctgccagaggctgtttgcatatggattgaaggtcctcttgggagagttctcattctgaaggaagaagttgcctggcaacaagagtttgacccatagagacagccttacccaacagaggagcaaggaagcctgactactgtgtgatgtctgtcacctagatccccctcccagcaggatgacaatttatacctaggagctatagagagtagagggtttgaatgtacaaagtgggggaaaataaacttgcattactaatcttttttaaaagagtggagtacaatgccatgtttcaggatctatgtgataaactgaaacataaatagaagggaagcatccctgcttttttttttttttttttttaactaaaaacagtttgggtatggtaatgtcaccaaagcattcatgacaatgcatggcaaaccagcaacagtaccaggaggaagactttgaagcccagtagagcatgaaggatagacccctgtaggatatgatagtatccagatgatactcattggaacatggatacacctagaatagagtagcagacagagtgacaaagtgatactcagcagaggactgagggggaacagttgcacccagtggaacagtgagtggatggaaaataatggtactagggggtggatgtgaagcagcatctttgtctgggataatacctgaggttcgtggtctcacgccaagaagattgaggacacggacacacacacacgaatgagtttagaagctgaggtttaataggcaaaagaaagagaaaggaaaacagctctctctctgagagagagagagagagagagagagagagagcgcgagccgccccagtgggaatcccagcctgcctaccgagtgcaccagattttatacagaggcttgaggaggtggtgtctgatttatgaagggcctacagattgattggaccagttgtgacgtttatatagagcgtggggaaggctggctgccccactccaatcttattatgcacatggacttttcacttggctggcgccatgttgtctgcttcttactgtacacttggctggaaaggagaagggaagacggagccacaattttgaacatgcctattcccaggcagccttttcctactggcacagctgctggcattcacctgtgcaaggttctagcttgcttgtctatgtctgcagctggattttacaggctgttctttgttagaaaagaaaatgatttgggggctgcttttcattaaaaggaaaaccttaccctcactatctgcctaaatgatttcttcttaactcctgtatcagatgttgatgtcaaagggggagccatcaaaggattttagagctctactataagcctaattgaactaacaactgctactggacttaacgagatcatgaatctctagtccaggatgttagaaagcctgcatcccatggccgtgcacaaaaagtcactgatagttaacttttcttttccaaatggaatttttttttgttcaatgtggtgctttctttaaataaattctttcacaaactgaggaatcctacattaattcaaatatttaattcatatgcatgtgttttctccaatttagtcccacagggaattcagttagcttataagaatgcaaacactttagcaagttttaacaaattcagaacaagtgaaacaactacacttaatctctctctactttatttaaactttaaattgggatttcagctatagcattagtataagatgtatgtgaatttttgtttccatagcttccaagctctttggctgttcagtatagtgtttatcataacccccactattgggtgagaaaagccaatttaagagactgagatgctaacactcaaagagggcaaatgacttcactgagttgtacccaaaattgctgtcttttcctaacaggttttttttcttcatttccttcttttgcctgatcaaataacacagagaaagtggtcctatttagtaagttgaaatacctctctgatacccaatgcaatacccaataagtgtacattgtgccttatggaattgacagatcgctgcgagggccaggtgaggcagtgactgagctgcccaaaacaagtgtcagtgagtggccacattgattttaagagcctatcaagtaagcataaattaatcatgaaaacaatcaagtttaaatttcagcttgtttggagtaccaatccttgataaaaaaggggtgggataatattttttccttgacacttgggcttcccattgaacttgagttactttccacctaaggggaagtgttatgcatttttggaacagaacccagatcaatgcaatatagagtgtattctttttattggtgttgtactctttattgtcaatcctggaataccagatctagaaataaaatgggagtagaattagaaggaaactagaatgatcaaattccatctgtataacaggtaatgtcatacagtattttattttgtgtgtataattttgagctttatctattatttatttattttgagacagggtcttgctttgtctcccaggctgcagtgcagtggcatgatcatggctcactgcagtctcgacctctagagctcaagcaatcctcccaccagagtagctgggatcacaggcatgtgccaccacacctggctaagttttcgttttgcttgatggggatgggttttcaccatgtttcccaggctggtcttgaactcctaggctcaagtgatctgcccatcttggccttccaaagtgctgggattacaggtgtgagccccaagctttactattttatctcttcataagctactccaaaggttagtgacatgtattacccggtaatttttgaatcacaaatgtcaacactttcagggtttgcaggaaccctccagctgatgagtgagattaatcagagcccaccatccacatttcagtgatttcgttctatttatgtttgcatagcattttataatataaattacatgttctaatagtattttaaaatttgactatacctgaagtgctctgaatatatctttcaaaaacgtcaagactatatggaactatggaactatcaaaaagatgtctgaggttgaagccacccgccttttattttattttattttatttttttgagactgagtctcactctgtcacccagcctggaatggagtggcgccatctgggttcactgcaacctccgcctcctgggttcaagggattcctgtgtcagcctcctgagtagctgggactacaggcatgctccaccatgcccggctaattttttatatatttttttttcatagagatggggttttaccatattggccaggctggttttgaactcctgacttcaagcgatctgcccaccttggccacccaaagtgttgggattacaggtgtgagtcactgcacccagccaaagctaccctcttaataggagttggagtttatgtctgtttgcttcctaagaccacactctttatatcaaaatgtgctacctgcttggaggtatttttgcatattatgttcaagtttatgagcaaaataattttaaactctgcttacagtaaagtagttagcaaaaccactgtctgaccttgaacttattttgaaggatgttttagttgatgggaccttaaatcactgttagaggtggctacacccaccatctggcaatatgaaaagcaatttttgccttgcaaagtgaggtcaggatctaagccaagagacaacttgtccagggcacaaggcccaaaaagagcaatcaggagacagagatgttcttccttatctggtaaatgtgagatatctcatactttgagttagggatcaattcagatacacccagattctgacttcaacatcctgccatggcagtcaaacgatactctaaggttaacatttttaaagttgtttttcttgtttttttgttttttgtttttttgagacaggatctcactctgtcgtccaggctggaatgcggtgctgcacctgtagctcactgtaacttcaaacccctgggctcaagagatcctaccacatcagcctcccatacaactgggactacaggtgcatgccaccatggccagctaatattttttttagtagagacagggccttgctacgttgtcccacctggtcttgaactcctggcctcttgaagctatcctcccagcttggcctcccaaggcacggggattacaggtgtgagccaccattcctgaccccaaagttatttttctgaaaggaaaacaaagattacccttagagagtttagggtagcttttcaataattagctactcttgaagatgactgacattctctcaaatgccatttcctcatctttcccatgtctgtcagtcacattattataacatagataactggtgtggggggaatcttactggtgatagtccagtgctctttatgacacattcacttctctaacccatggagacttccataggatgctcagtgttatcctagatcacaggtgtccctgtcctgatgtcaggttaatgaaggtggcttgtggacttggatatttctgggaaattttacaaggggtaactaaagtaaaagagaaagaaatgcagaaaaatagaaacagaaattctcaccatagaagcttcattatgtatttgcaagatattcacacactctagattttctaagacagttctgaagttaaatcaccttattcttaaaaatatgatggattatgcttatgtttatttaagtgtatatacatctgtgttgggtattcatgtgtaacattttagagctcatattttcatggctgtctagttttctttttcttttttttttttttttttgagacggagtcttgctcttgtcaaccacgctggagtgcagtgatgtgatcttggctcactgcaacctccgcctcctgggttcaagcgattctcctgcctcagcctcccacgtagctgggattacaggcacccaccaccatgcctggctaatttttttgtatttttagtagagacagggtttcaccatgttggccaggccagtctcgaactcctgacctcaggtaatctgcctgccttggcctcccaaactgctgggattacaaatgtgagccaccatgcccggcctgttttttaagagacagagccttgctgtgacacccaggatggagtccagtagggaaatcgtagctcactgcagactcaaattcctgggctcaagtgatcctcccacctcagtctcctgagtagctgggacaacagtcatgcaccaccatgcctggctaatgtatttgtttattttttgtagagatagggtcttgcttaattgcccaagctggtcttgaactcctggcttcaagtgattttcctgccttgacctcccaaattgctgggattacaggcgtgagccactgcattcagcctgctctctagttgaatgacttcaggcaagatactcaacctctttgatcctaggtttcttccttattacagcatggagactactacctaggtaatatggttatcgtgaagagcaaatgagaatcagactaagcacattgtagatattcaacaagtttacacatttgaaaatgtccagaaggaaatttatcacaagtacttgtcttcattggatagtgagactatgaatgcgtggcatgtgtatcccaggctttcctagcttgccaacacaagtgacaactaatttatgttaacaacactaatggaaacttagtgaatgcttactatcagccaggcaccctgctaagctctcctcatggattatctcagagatcaaccagatcttactggcttgtgtcctcagctagttgatcaaaatttagttttatccagatcccaaatattttggagacttcccagtgacatatttacatgtccttaaatcatttttctccaaattctacttgaccatttgaaaatggatatatgatcctcaaagctagatcaatgcccagtagttttccttttttcctaactcctaatgggtgctgatttcatggagtcaggagcccctgatagtttgaggtttctaaagtactgctgcagccaaggttaagcctgggatttggcctcgctcactattaacaactgataataaaatgcaatcagaaatccccaatgtttctgttgaaggatccagaattctagcaaccctaagatattgctgctgttgtgctggggattggtagtccaagccccagccatcccaccaggttgtagctgcagttgaaaagtccactcctaaggtctgttacacccaggaaatcagtgtctgggtccaaaggatcattggtggtacacttcttttagctcatgaacacacacaccccatgcatacacttaggcaaatggtgcacacacacacaaacacacatacaccatgggcatgttccccaaccccacacatagttcaaaggaagatgggttaaaatttatctgtgcttaccttgtaactgattctagattacttagttctgagcttatgtgttgctttcaggccttcttggtctgttccatttgctattccagcaactgacttcctttcaggggtttcactgcctttttcagtgacccctcctgggctgggcctacatagcccatgagacatagattttaccctgttaattttttaacatagttggaatcactatcccattccatatttcaccaggggaatccctagttccctatgtaaatatcaggatgtacatggatgcttgcagaggtgagaagggtgctccccagtttcagtcaccagctgcaccaatatcccaaaggcagatgcatgtgttaaataaaaagtaatgacaactaacagtgaagattctttatttttgaagcatttttcttgtgataaaaaaatagcgactcttatcatagcttaggcctgatttttacaattttaactgaaggttgggtggctctgtggctcatgcctgtaatcctagcactttgggtggctgaggcaggaggatcacttgagcccagcagtttgagaccagcctgggtaacatagtgagaccgtttctaccaaaaacttgaaaattagccaggcatggtagcacgcacctgtagtcccagcaactcaagaggctgagatgggaagattgcttgagcccaggaggttcaggctgcagtgagccatgattgtgctacttcactccagcctgagtgacagagcgagaccctgtcttaaaaaaaaaaaaatagccactgagtttaatcataagagggtatggaaattcacactctcactttggtgcattgggaaaaaagctctctaacctactccattaccataaacagagaatccgttcctctggtatgtttcaaatgatcttacattatcaatggattgattaacctcagtaatgatttgttggacggccactattaataataaagacttttaaataactccttgtttcaaaataattattttttcacctttattataattatataaagaagatgtacccattttatgagtacatttcagtgagttgtgacaaatgttagcacctgtccaattatctccctagtcaagttctatagcattgctgtcactccctatcttagtccattcaggctgctataagaaactaccataaactaggtagcttataaacacagtttctctcagttctggaggctgggaagtccaaaaactgggtgctggcatggttgggttctgatgagaaccctcttctgggttgcacactgttgacttctcaaatggcagaagggccaaggcagcttttggagtctctcttacaagggcattaatctcattaacagggctctgtactcatgacctaatcactgcccaaaggccctacctcttaatgctttcactttggggatttggtttcaacatatgaatttggtagtgaggggtgggccgggcacagccattcataatatagcacctcccaggccaggcgcagtggctcatacctgtaatcccagcactttgggaggccaggacaggtggatcacttgaggtcaggagttcgggaccagcctggccaacatggagaaaccccgtctctactaaaaatataaaaattagacaggcatggtggtgggtgcctgtaatcccagctactccagaggctgaggcataagaattgcttgaacctgggaggcagaggttgcagtgagccgagatcatgccactgcactccagcactccagcttgggtgacagagcaagactctgtctcaaaaaaaaaaaaagtaaacaaatatatatgtatatatggcactgcccaaatccccctattaacctgtcatctaggttttaagctctgcgtgcattaggtatttgtcctaatgctctcccttcccttccccccaaccgcctgacagacctggtgtgtgatgttcccctctctgtgtccatgtgttctcattgttcaactcatttgcagtcagtctctcctaagcacatccactaatattatttctattactgtagattggttttgcctattgtagagtgtcacagatatggactcatacatgaagtatcctgtatttggtgtctttaattcagcataatgttgttgatatccattcatgtgtttgtgtatgttaatagttcatcccttttattgcagagtagtattttcttgtgtagatacaccacagtttgtctatccattcatctggtgatggacatttgcactgctttccacttttcagaagctgctgtgagcattcacatgcaagtctttttgtggacatatatttgcattttaaaaatacctaggggtgaaaccctaagtcctgtggcacatgaatgtttaacttgaaaaacactgccaaattgttttcaaaagtaactgtgtaattttacacttaccagcctggtaggacagttccaatttcttatcagcacttattattgtcagttttgtttaaaaaaaaattctagaaagtatatagtagtattatgtggttttaatttgcatttacctaatgatactgaacgtctttccatgggtttatttgccaccaatatcttttttttttttttacaactctcaattttacttcaacaattacctggatatcaagtgcttgaataaaacttttagtaatatttaaatgtttcagatacaatttgtcttataaatttacatatagaaaattataattttgcattctattttctggaagatttttctttttccaataaattttttttttggggggatacgtttgtagaatgtgaaggttcattacataggtatacatgtgccatggtggtttgctgcacctattaacccgtcgtctaggttttaagcccggggtgcattaggtatttgtcctaatgctctcccttcccttccccccgaccccgtgacaggcctggtgtgtggtaatcccctccctgtgtccatgtgttctcattgttcaactcccacttatgagtgagaacatgcggtgtttggttttctgttcctgtgttagtttgctgagtgatggcttccagcttcatccatgtccctgcaaaggacatgaactcattcttttttagggctgcatagtattccatggtatatatgtgccacattttatttatctggtctatcattgatgggcatttgggttggttccaagtctttgctattttaaatagcgctgcaataaacatacgtatgcatgtgtctttatactagagtggtttataatcctttggggatatacccagtaatgggattgctggctcaaatggtatttctggttctagatccttgacaagtcgccacactgtcttccacagctgccaccaatatcttatacatggtgaagtctattcaaatcttttgcctacttaaaaaattggaatgtttagttcttgtattcagttgtaagagttctttatatattgtagatacaagtcttttgtgagcatataaattagagctatcccctcctcacaaagtaatgacagttttgttatttaagcctcatagcaaaaatactacatacagctaatttatgtttaatcttttttatatttccaaaatgtatataatagaagatattaactttattttttaaaaaagaaaaactgatcatcagacctttgtttccacactttgcttcaaaaagtgtgcttagaatacatatatgacttacctagagtttttttttgtaatacccgccagtccagaaatagaggtggagaaagaaagatgacttcccagcaaagctttgacatatgcaaaatgtaacttgaagatgcagtatctctttttttttttttcttggctccctaatgtgatgtgccccttccccaagtgctcctatcccagaagagtttaagcaggcttctttccagggttgttattgtatttttttggatctatcaaaagatttatagcagcagcaaggccaaatgaaggaggaatttgtgggtctgaggggccttactgagaggccctgaggtaacactatattgtaatggttcaccttacttacctttaaagaaggttttaaaaagagtaaatcagagctgggtgagttaatgttagtgaaggaatacagcagctctgtcacatgggctccttttgtaggaggtatccttaggcttcgtttaatttcgaattggtatgcaaccaagagtgcctcctgcatctctgagtgtctccactgtggagtgccctggtggctcatgagaatgcattaaggggcaatccaggtgggtggcaagacaaggcaggactgttcacactacctctcttgccccatcactttacagcattcttgtaccatcttatttttctccagtgacataaagagcactctgccttgctttgtcaactactgaagccttgtaatacctatcaagacaataagtgagggagagcatttgaggagctagagaagagagctgaaggaaaacagctactaaatttagtaagagaactggtgtgacttacatgagatatagaaaacaggcaaacccatagaagcagagagcagaatggttgttgccagcagctgggggacaggggtaaatggggagttgctattcagtgggtataaagtttcagttgtacaagataattgagttatagaaatctgccatacaacattgtgcctacatttaacaacattgtatgataaatacagcattatcaatatattgaaaataaagacagtagagctcatgtttagtgttcttaccacaatagagagagagagagagagagacagagagaggggagagtgagatataaagagagcttttccaggttttagtttgtgagacatgatttgcttttttaattggagtttgggatgaagaagaggaaatttggggttcctgccaacgtatgagagaagaaaaaaatagcaaaatggaaaaaaagataattttaagaagatcttcatgagtgtgcataaattatgattcctttttgacctgtctaaaggcttgatttgcttttctattactttctagttccagggtggtgttactttgtgtgcagttatgatactgagtggtggttcatgtttatacagtttgtacttggaagccatgagggtgtgagattctttgggaagacacatctcacttttatctaagaagttttgaaaggatgccaatgttgagttaaaagataacccctactgtgggagtatgtgtcagtgatttcctcactcagagttcttaggaccaaattaaactccaggagatggtcatgtcacttgttgaaatctcaggcactcttatcaggacctcttaacctccctatggttggagcatcttctactgacttatttaaggttattagtaggaccattttttggaaagatgtcctgcaattcaacatgtttgtaatgagacataccaactctgagtcatcacataatggagatttccagaataattggagagaatttgggttcctgtcagttagatagtatttgattctgtagaaggagctgactcttgctgctatggtttcaatgtgttccccaaagttcatgtgccggagatctaatccccaatgcaaccatgttgggagatggggtagcctagtaagaagtgattaggccaggaggtctgtgttcatgaatggattaatgttatcataggagtgggtttgttagcatgagtgagtttttgtaaaagtttggccctctcttgctttctcactgtctccctcccttaccctccaaccttccaccatgattgacacagcatagaggcccttgccagatgccagtgccatgctcttggacttctcaacctctagaaccatgtgtcaaataaatctctgtttgtaaattaaccagtctgtggtattctgttatggcaacaaaaaacagactaagacacctgtggagagtacagattgattatggatgaactatctctacccgtagagaacaagacagaagcagtagcagtcgctggtttagaatgtgtatcaggcactgttgggttttgcccaaagctcctctgatctcttttcagcactgtggtcctatgccccggtccttgctgctaatggctaatagctaatggtatctatttgcaacttccagaacattgctctgtgggagtttgctttcagattccctttccactttgtgttggttcatagccaatgactgaatgtcacgggagtaaaataacccagctcctggaacagcaaactccagggttgaatttatgctagtggtctctgtgagagcaggctgaggctggagtttcaggatcacaccttgtttggtttcatctttccttactctgcttttctggctccctttttgatttcttctggaagctctccctcaataaattactgcacctaaatttctgactcagtgtttcctcctgggacaacacaactataaccagaatggtgaatgtcttggagatattgaaaaaagccagcagaaaatataagctgtttgttgttgctgttcttgtatcggtgtctcatgggcagtatgtgtccacagtcgtatagaattgtcgattttcaaggtttcgtggcgactctgtccaaaagaactgacaaataatcacaattaacctggctctgccatgtaagcatagttactaacagtccactgtttaaattttgaaagcaaagattatgcattatataatttaagagaatcttgttttgagactgagccaaagtaacacaatttattatatcttaggattataaagaaagaaaatgtaacaaatacatggaagataggatgcctaagattgagaagacttcagttcttatttgaccattttaggaatgcatgtgatatctcaagtttaagaacttaaaacagaactaccatttgaaacaacaatcccgttactgggtatatacctaaaggaatagaaatcgttctaccataaagacacatgtacatcacagcactatttccgatagcagagacatggaagcaacccaaatgcccatcagtggttagactaggtaaagaaaatgtggttcatacacaccatggaccactgcacagccataaaaagaacaaaatcatatcctttgcagcaacatggatggagctggaagtcattatcctaagccaactaacgcaggagcagaaaaccaaatcccacattttctcacttataagcaggagctgaacattgagtacacgtggacacaaagaagggaacagtagacactagggcctacttgagattggagagtggagaaggataggtacctattgggtacctatgctcattaagtgagtaacaaaataatatgtacaccaaacctctgtgacacagaatttacccatataacaaacctacacatgtaccctctgaacctaaaataagttgaaaagaaaaaaaaatgtaaaccagtaccaattatcacactgaaaacaaaatcttttgtaaacattgtaacactaataaaacttgaaggtaaacaagaaatagatttgtctcttcttattaagaatttcatcctactgagattcacaaacacactaatatattaccttatcttctaatgacttcagggataatgattttatatatacatataggattgttattgttgtgagagggaaggaagttaagtaagagcaatagcttagtttttgaaataaaagtttacaatgtttttactcctggtaaagagaagttttggaagaatcactggacttatttatatcgataattctaaattatctttgttatctgaaaagtaaatagttgttatttaagcattaaaataaaaagcaaatgcaagcttctttatgatttaatctagtgaatagttaccaccttcctgggtatagtaactgattcattttttactctaaatgaagaggcagtttctgctggagagaattactggttcatcatattacatgggaaaacacagtctgggaattgaaggacacttagcataattttgagaacttaactgtgcaccagataatacgtggaaaaaggactcaattatattaaaatttaatcgctcttgtagaaatcttcgctatatgcctagcaactgaagaatgatactaaaaaatatgataaggtcattaactgacatatttgccaagaattctaatgagatgggaataaatgatcaaactatattacatttttaatgtaaaatattttactatctaatattttaatattaaaaaagtaaacatgtactctcaatcatatatattaaatatgcatggaaaatatggtattatgatacttcataaagaatattaatgagtattctttgatggtagaatcttaagtgatgcttattttcctctttatatgtttgtgtctctttaaaattttctacaataaacatccattcataattataaaaataaacacttttatggaaaaaactcagttctatcagatatagctaggtgggtttgaggctggagcaaaacttgagcaagactgtttctcctgccattttgtaattttgtatccaatgttggagtctcagctttctgagagcagacatcactgtgttgcatatgactggtatgtggcaggcagtccatagataagtgttaaatgaatgaataaataaaaatgatgaggagcaaagatgggcaaccaacttaaagaagcaacatgtggaagtaaatgaaattggtaaatatcaatgtggaaatgaaaaaccacagataattcagcaaggttgcagtgtaggcagttagagggctggggtaggaaatgctgtctcagtctctgcattacagtgtcttattgtccctatgacatcctgccaaatgcttattttcccccccattttctagatgagaactgagttttcctaagcttaagtgatttgttcaaagttgcaacattgttaagtaaaattcagatttgaacccagctctatcctgcttccaaggagccttcttgttcccctgcactgcagagacagaggtctggaaacctgtgtaagcagataggctcttgcaggtaacagaatgccattgagttttgagaagaggaatgacgggatttgtagggcatgaagctgagccaaggggcaaatcactcatctcatttctcccttccagtatctcttatgttacctttacagtacctgaactcccacccttcttgcccctttgggttaaggttcagaagagcttgggtaaaatgctattgttacctaggaagggtatcccaaggcatgaataagttttcagtatgcattatcagagggtaaacccctgaaggaagtggacacatttctttttttttaaattcaataatcctttatggaatacttactgtgtgccattcactgtctagatttttgatacacaccatgaatgagaccgatactatctctgcctttttagaatgatggcctaagaagcagaagtgatcatttttgttgcatatgggagaaggtagacaaaaagtttgaaaaggtaaagtgatgatgcaaacagagtccaggtagggaagagaatccactatggaagccaggcattacagaggctcacatggtggcctgagaaagggaggaactcggacagggagcttggagatcctgtatttcacagtggagctgtcctcccatccttaaaacggcgtgacaacatcacgtttcctctctagataacctcagtctagggaagggattaacacagtagaactatagcatgaatcttgcctgcaagagaaaaatgagctttgaatcattaacaagggaattgctgctacatactaatgatgctatttcccggccctggtctttttacattaatgcaccctatggtgtgaactgaatgatataaaactgattacaggctttggagatatttctggttttgattgttttatgtcatgcaccacttgtttagattatgaattaactaatctgcgttactccctaagttttaagattgaaaagcccttactcctttctctgataccaaattaatataactatctctgatgacagccaatgaagactaaacaatagccattcgtgtgatttacttcacacacacagggtccccacaactcccacccatcttttctaatgattgagagaatgtctccagtattacgaataatttattctagactcaatgtcatttatcttagcttgtagcagcctgccttgtgcaccttagactcaacaaatatttatttaatttataatttttcatatattttgatctattttgaggaatctagccgaacataacaattctaaataggacaaaaaaataaaattatactaaaggatatttaccatatcttaagatacaggaaacagtacagtgtctttcctagtctagctcacacaccactcaacacttctgacactaaaatgagtgtgcaatgagagataggtaaaccgaactgattttttttccctactcgcttacaaagccactcatatgacacagaatgcttctgtgaccagatgtgtgggggggttttctcctcacaccaaccaactggatgttctataattcaatttaattctgatgctatttgcctgaagatagtgtcagatccaacacgttaaaggcaaagatgctagttacaagtagtaggttgtcacctatacttctgactgaccagctggctataaactggggctcccatcactcactccttggattcaattaatttgctaaagtgactggtagaatgcagggaggtgccttacttacgttaaccgacttataaaggattttacaagggatgcagatggatgccagatgaagagatggatacgttaaggtatggaggaaggggcacagaactcctgggtctctctgcaggtgcatcaccctttaggagtctccatgtgttcagctatccagaagctctcagaacccagtgcttttgcttttttatagaggcttcattaccaaggcaagattgattacaacattgatcactggtaattaatttaaccattagcacttctctccctggaggtcaaggggatgaggctgaaagtcccagttctctaatcatgctgtggtctttctagtgaccagcctccatcctgaagctatctagggtctcccagctactagtcatctcattagcatacagaaaacactcctaacactcaggagattccaaagagccatgtgtcaggaactggagataaagatcaaatatatatatttcacagtgtcacaccatagtattatggagatggagatcaaatatgtatttcacaatgtcacaccatagtattatgtatggtataaaaaaaggaaagactctaagcatctaaatatgctaatataggaaattattaaaataagtagggcttttcaaatgatgaaacaatatacagccatgtaattttttttgcaataacagggaaagatggtgatgccaaggcattatgcaagaaaactgggggcagattttattaacattattacaattttgtaaaacatatgtagaaatcttagaaagtatgctaaagtgaaaagagtggttttctttggataatgataccatgagcaataatttttttatttgaaataggtttttccaaattggaaaaactattcttgaaaaaatttttctatacttatccaatcatcaatcatatgcttgtttgagggaaaattatgcaaattcctctaaaagtctgttgtagctatgaagcccagaaaactggaagaatttctgggcaatggcaagtcagtgctgatacctttccctaactaagaaatgtctcaaacatgggtcactctacgggacactggaaattccctacaccactctgagaggctgactactgatctttgctgacacttcaaatggtattagaaagtggactgggctcaggattagaggtacatacttatgtcgagagcagatgagaatcactctactccttaggaagggcttcaggttatgcctgtaatcccagcattttggaaagctgaggtgggtggatcatttgaggccaggagttccgaaccagcctgaccaacatggtgaaaccccatctccacttaaaaaaaaaaaaaaaaaaaaaaggaaaataaaaaattatccaggcttggtggtgcacacttgtaatcccagctactcgggacgccaaggcaggagaatcacttgaactcaggaggtgaaggttgcagtgagccgagatcatgctgctgcactccagactggtaacaaagtaggactctgtctcaaaaaaaaaagaaaagaaaaaaagggcttcaggaatcacagagctagcttatgattctgttcttttcagacagctggttagtggtaaaataatgctccctctcctgactcctaattcagttctacttccaacacattaagttgaaccctatgaaattgccatatttgtagatcaaaatggtaaaataatatgaattttgtttggttcaaccacataggcttgctcaccttgatgcaatttatagaaattttttttaaaaagagtttcctttcaaatcaaagcaaaacaaatttatacttttaatgatgcctgaattttttaaagagacaaacttccctacataatcaatgttctgattcctaaatcagaccttcggtgtaaaaagagaaagtcccaagtaaaagtgatacatttacttatactgtgtaaatgacttaaagtaaaccctttcctagaggtcaggttaagcagaaaaacattgagttcctgaaaggctggataaaaaatagaataggaaataaatatatattcaaatattacttgataccgagctagtcattttcataactgtcattgtatttagccccttccaatgtctttttgagctaaatattatcatccttttttctaatgggtaaactgaagtagcctgaggttaactaaattgtccaaagtgactctgatggccgaatactccacatcatgatttttttccctatatcttactgcatccataagaattgttgcaaggcttatatattcttttctaattaaaaaaagtactctttctgattaatgtattaacttggattggtttcaaatttcacagtggtaaaagacatatagtttaaagtcctgtcaaatcttcagaagccggtcatagtgtgtaacaaagctataagattttctctcctgtttccgtttccgtttttttttttttttttttttttggcttccaatttagtttctcctccaactcacctgagtttttgctttttaaaagtacaaacagtagcaagattcatttctagcatgatgtagtgaggaggtcaataaatcctttaccccaaaagcagtaaaaatctggataaaactgtttaataccagccgtttgagtgctgcagaaattggcccaaggcttaaaaatccaagaagcatttattcacaaaagctactgaacttcaagtaaaattggcatgagtcatggtgttttcgtctaagcagtttctacccctcctctccctaccccaaccctgtgggcctggcagatggaccagggcatggcaagccaggaagaccaggatctttgctcacagcgccagaggaagttcattcattggtgtgttattaaagttgttcttagtctctttaaaagatagaaggttaatagaaaattaatattattgctgagtacatagcatttacggatgttctttccagaaagctgttcaataagacagcacaaaagaagagaaaggaaaagatgtgtatattaaagtttactgtattgagttagcataattttgaagtagactgtactatgttaagatgcgtattataaaccctagatcaaccactaaaaggtaattcgagaaatatagggaaaaactcaacatagaaataatatactaaaaatattgatgtaacatgaaataagttataaaggagaaacaggaacaaaagacacagacaaatcaaaatggtaattgcaaatccaaccataccaacaattacactaaatgtaaatggaataatgagtaagtgtctgttaaggtgatagtgataggtataattagtggaattagagctgttgaagtaaggaaggagtatacatttactacttttatttggggttgcaccaatattttggttcctaagaccaatggaaaactcttatcctttaaagattgagaaagctgtattaaaaacactccactcaaaatgtagattgtcagactatatataaaaaaatcaagatctagtgtaatgctacctacaataaatggaccttagattcaaagaaacaaataggctaaagtaaataaatggagaaagatataccatgcaaacagtagccataatatagctactgcagatctcttaatatatactttaatgcaaaacaacttttaaaatgaagaataaatttagaggacttacactacacagctttaaaatgtactataaatcttcagtacttaaaacaatgtggtatcacgtaaagatagacatagagatcaaaggaaaaaaatgaaagttcagggatatatccttacatgtatgaccaagtgattctttacaaagatgccaagataacagaaatgaaatggtgctatgacaattggctatccacatatgcaaaagatgaagttagaccttttgcttactgtattagtcagggttttcttagagggacagaactgataggagatatgtgtgtgtgtgtgtgtgtgtgtgtgtatatatatatatatatatacacacagagagagagagaggagtttattaagtactaacttacacgatcacaaggtatcataatgggctgtctgcaagctgcggagcagggaaagccagtccgagtaccaaaactgaagaactgggagtgcaatgttcgagggcagaaagcatccaacatgggagaaagatgtagactgagatgctaagcccacctctccacattttttgcttgctttatatttgctggtggctaattggatggtgcccactggattaagggtgggtctgcctcccccagtccactgactcaaatgttaatctcatttggcaacaccctcacagacacacccaggatcaatattgcgtccttcaatccaaattgacactctgtattgaccattacatttacacatacaaaaaaaaaagcctcaaaatgagttatacatgtagatgtcagtgctcaaactataagacttttaggaaaaaatgtgggagaaaatatttgtgaccttggcctaggcaacaggttcttagagatgatactattagtcatcaaaaaaaaaaaaacaaaaaccagatgattgaactatattaaaattagcaacttctgtgcttcaagagatacctttaagaaaatgaaagatacagctgagaaaagatatttacaaaccctttatgtaatagggaatttgtattcatgaaacataactcttacaatttaataagaaaaatctagtgaacagtatgaacaaaaggtttgagtaaacatttcatcaaaaacatgggagcaggacatggtggtgcagtcctataggcccagctacttgggaggctgaggcaggagaatctcctgagcccagcagtttgaggctgcagtgagctctgattgccccactgcactccagcctcatgacagagtgagaccctgtctctgaaaaacataaaatagaccagcctgtgcaacatggtggtgagaccctatctctaaaaagtaaatagctaaaaatgaaataagaaattatttttaaaaatatgaattactaatgagcacttgaaaacgtgttcagcaccattagttaataagaaacacagtgagataccgctttaaacacactaggatgaccgtcatgaaaagacagttaccaccaaatgttggcaaagggttggaactgaaaggggaaaaattaaggtaatggttaaagaggctggtagagacagaagcaagagtctggcacctggtgtgtagcatgatatttaggaagcttcaaagatggggagaaactgttggaaatgtaaaatggaacaacaacctaggaaaagtttggtgctttcttaaagagttaaataaaactgaccatatgacccagccgctctattaagaatctacccaagaaaaatgaaaattatgtcttcatgcagattgtacactactgctcatagcagcattatctctaagagccaaaaatggaagataacccacatgtttataaattagtagacagacaagacgaaatgtgatatatccatatagcagaagactattcagtaattaaaaggaactgaatactgatcaccagtatactgatgtatactgcaatatgaataaaacccaaaacctttattctaggcacaaaagactctatattgtatgattccattttttaaaaatatccagaaaaataatttatagagacaacaaaaatataggttgcctgggactgggggtgagaacagtttaaaagcaaacatgcttgagggaattttggggggtgatggcaaagttataagcctggattgtggtgagagttgcacaagtctacatatttgctaaaggcattgagctgtaaaattacaaagaatgaattttatggtatgtgaattataccttgatataaaagtaaagtataatgtgaacctggaaaagaacatacatagggaaaaactggctatgaccccttgatgcgttcttccaaggtgagaatgggaaccactgattatttacactgcttggtgtggaaagtttgaagccctcgccttgaactagcatgggaaggtagctctaccttgaagagcctcttgtttttgttcttgaaactgctgggatggtcatggcttatgtcttctgggtgtaaaactactcatcaatgcttgctccttttcagtattttggggtctcttccagggtgtagattttaagctagaacaaaattgggtggaacgtctcctctttagggtttacaatgtgaaactgataatgtgagaagttccactggaggaaattagtacttggtcctaacttgggaccaataacagaatgatgcaaagtagctattcaggtttaagtatgtggaataacaggatatttgtttcagaaagttgaaaaactatagcaactgagaaagatggtggcttacctcttcatattgtcataaatatctaccagaatagaatggaaacaataaaaacaaaaaaggtttaagaataagaaaacaaagctgttactaaaatcaataatataggaagctttatagaattttgcaacagaatattacaaccaatgcatgtgtgaaaagcttcttcttaggccttgtatctcaaagatattaacattgccgttttccttttttatgaacacttacaaacttgccattgaattcattgctgtgaattcaaccataacaatgtcaggtttccaaattctcaagatcatggaaaacaaccaacttggaaataataaagcatacactttagatttactttccaatgtttgacaattaaggattttcttaaaaagatttataacattattccttgatgtttattgggtaactttcatcattttcaaaatttcatgaattctgaaattagccttttaaatatagctattgggtatagatatggaattttcttggagagaaaaaatattttattacttcacttcccttattaaatgctatttttattgggaaaaaatgttttgttggctataaaatatatagtgtcaataattaaatagtatatgcattaaatcaacactagagtaattttccttaggaaatttgttcacaataaactaaacaactataattctattataaatactaatagggattaaaaaagacaaccaagttcttttgtgccagtaagactgagaaagctcttttgtccatgacagagtactgaataaaatttgatttttgacgtctggtttctggaggagagtgaggctatgactggcatgaaaatagttcaggaatattaccatcaagagttggggagaggctgacggcacaaaggtggcatgtgagtttgcaagagagttaaaaggagaaagatggaaggggttggggttgtagatgtgtagatgtgtaggttgtagatttctgagacctctgttcagttccattggtctatatatctgttttggtaccagtaccatgctgttttcgttactataggcttgtagtatagtttgaagtcaggtagcatgataccgccagctttgttctttttcttaggattgtcttggctacacgggaagacctaaaaccataaaaaccctagaagaaaacctaggcaataccattcaggacataggcatgggcaaagacttcatgactaaaacaccaaaagcaatggcaacaaaagctaatattgataaatgagatctaattaaactaaggagcttctgcacagcaaaagaaacttatcagagtgaataggcaaactacagtatgggagaaaatgtttgtaatctatccgtctgacaaagggctgatatccagaatctacaaggaacttaaacaaatttacaagaaaaaaaaaccatcaaaaagtgggtgaaagatatgaatagacacttctcaaaagaagacatttatgcagccaacaaacatgaacaaaagcccatcatcactggtcattagataaatgcaaatcaaaaccacaatgagatgctacctcatgccagttagaatggcgattgttaaaaagtcaggaaacaacagatgctggagagaatgtggagaaataggaatgcttttatactgttggtgggagtgtaaattagttcacccattgtggaagacagtatggcaattcctcaagtatctagaaccagaaataccctttgacccagcaatcccattactgggtatatacccaaaggattataaatcattctataaagacacatgcacacgtatgtttcttgttgcactgttcacaatagcaaagaattggaaccaacctaaatgcccatcaatgatagactggatgaagaaaatgtggcacatatacaccatggaatactatgctgccataaaaaaggatgagttcatgtcctttgcagggacatagatgaagctggaaaccatcattctcagcaaactaacacaggaacagaaaaccaaacaccacatgttctcactcataagtgggaggtgaacaatgagaacacatggacacaaggaggggaacatcacacactggagcctgtgggggttggggggctagaagagggatagcattaggagaaacacctaatatagatgatggattaatgggtgcagcaaaccaccatggcacgtgtatcactatgtaacaaaactgcacgttctgtacatgtatcccagaacttaaattattaaaaaaaatagataatagtagtgaaaaggagggacttggcttgtgtcatcacatttaggaagtttcaatgaatcagggagtgttttccttccacaagactgctctgcactggcaaatatccctgctggctttaaggactgcttgggatacattccaggtcacgattgtttttgtcatctgtcatataaagagctgagggttgtgagacaggggttcacctctgtcacccaggctggagtgcagtggtgtgatctcggctcacttcaacctcctcctcctgggttcaagccattctcctgcatcagcctccagagttgctgggattacatgcacctgccaccacgcccagctaacttttgtatttttagtagagatgggagtttcacctttttggccaggctggtctcgaactcctgacctcaagtgatctgcctgccttggcttcccaaaatgctgggattataggcatgagccactgcacccagcctattttctgttattataaatgcagggtaaaaatcattttttaaagctgcctgatacatctttttattctccattttcttggtatcacaaatgatactgcaatgaacatttttgtgcataattagttttttctacatattgcagaatatttacatagggcagttgcccataaatataattggtgggctaaaattaataaacattaaggtttaaggctcttgatagttatattttatgtttcttccttagcagttgcatgtctatcagcaatgctagtgtcctcttcacccacaatgacgctgtatatcatcattttaagaagttacttgctaattttgtattctctaaactaaagctaactctctaaacaaattcaagataaaacaacaaaaacaaaagtaatatcgtagtagaacctaatctttcttcagtgcgtgctgtggactaaatgctttatgtgaactcactctgtattccactgacctttttcaggtgaatattacattatgtctagtcaaaaaatgagtaaatagagaaacaggttatgcaactatcccaagtttaaattgctggtatgcatacttccaatttattaccaacctaccagtttgtattcatcctatttataaattaggacacttgtattctccccactgactaatgcacattccaatatttttttctttctctgtatatgcccctaccccttttttttctgctgtggtggactcctattccttctttagagatgagtcaccactctgtgaggtcttccttgtagtcatcaccttccttgagtaattctgtcaccttaatggttctgcagcgctgtcatacaggtaaaattacttttgggtatgcctttctttcctgctaaagaactgcctttgccagaacacagaaaatgtgccatgcaatgcaaggcctccttcctacctccattccctgggtggatgggcaccagcacaggaatgtttattgttggatgtggctgggctcaggccacttctctctctcctggacctgtcttacattcatggacaactacaatcaccatttctgttacttaaaatacttgtctccagcattctctccatcaaatcagaaattctagagcagaaattatttttaaaaagttctccaggtggtcttcatgtaacgtgagagagagctactctttgggaatcattgatctggtagcttagtctgaaaaactggtgctttggaatcactggcagccatgccgccatgctttgtagagaaagtgggctcatcagtttcatcaaaggccaatcattctgtctctctgcaagtacatatcagtaaaagggaagagaaaattaacaaaataataaaatgttagaaatgaatggagcatgatgatcataccaccaataatactaaaactaatgtttattgaccatattatgtaccagatgctgggccaattgctgtatgtgcattatctcttaatctaaagctgtgcttatgaagtaggggattattatcttcatttttcaaatggagattctaatatttagacattaactaatttcatcaaagcgacacagctagtaagtacgaaaccaggatttaaaataggcagcctgactggaatctgcatgattaaccctgatgtaaggggcatgggggagtttaggggaggaacttagtctaaccctacatctttcatgtttaaatagcaaaaagaagaaggcagaggactggtgtgatttaattaataaagtttatatatccatatacaagtaaaaaaatcatcttttcaagtttccatgaaacaaatgttcatgtaaatacagaatgggttcaatactgggccaaatataaaatactaaaaaaacagaaatcatgcaagccacatttactaataatagaataaaaattaactatttttaataatacaagtcagcaattttcccaaacccaagtaaatattaaataaaaggagaaatcataagtggaattatagatgatatgtaataccatgaccatggaagctatacattaaacactttgacatgcagccagatgaatacttcctacagcaaaatagggcaaaaactatcttaagagttttcttttttaacaagagggaattaaaatcaataatcataacactgaactatttcttctaagaagataaaaataaaaacaaagttaccttttggatgcattaggctgatgagcatgtgacccagccacatcctctgaatggaatggaatggaaatatgtgtggggcaatagctaaggcctaattatgacactgcagatttagattttttgtttctcttctatgtgtttaagtcatttccttatggaagtcacttaaatggatctgacacttacaaagccattattatctgctgtgttgtattctgtgttctttgaagtgattgcaaattggtagataaatcatgctggtagattccaggtttcaaatgtaggacaactcatctataattattaaaatctcctagcaatttcatctctaaaactgccataaatggtatatatatatatatatatatatatgttaatctatgtatatttatttgagagtgtgtatatacacacacacacacacacacacacacacacacactgccttcataccatagacacaggatgctctataatgcatattttgtttattcttagattaattaattttcttctctcttccatgaaatgctattatggcatttttaatcacaactgcaattatcttaagaaccgtaccaaaggagtgtcaggcattagtaatttcattaattttagtcattatgccaaaatacattaatttaaaactcatatactcaaataatcaaaataatgcctttttcactacttttcaatgtttttctccagctctagttttttctatttttatcattgctagtaatacccttttcctttgcacatctgtgatgagcttttatgataatagaagttaatttttttctgcctttttagagtattgcattagcagtactcttctttcagggaaacaaaattctcatggtcgtttacttgtgctttaaaatgatttaatgatatttaaatgaatgtttatattttctaccttgcattagagttatatgtgtatgttaactgttttatcttcactcaaagtgtgagcacctgagagaagttttatactttggtattctccctggcatatattacatctatgtccacatacatatattccagtactttgcacatgttagctgctcaatttgcatacattaaatgaagaaaaaaatggtgacttttgtcttttgcaggcaactttcccattctcatttttgctttctttgagctgttttcctgtaacacacctaattcagccaccactgtggaaagtgttctttatctgatctgattgctcaatatcagaagggttacaaagattattccacaatgaaacctaagttgttgtttatgtatttaaattaaatttggatcccactactaggaatctactcaaaggaaaagaaatgaatttctctaagggctacctgcatttgcaggtttattgcagcactattcacaataacaaagatagcaaatcaacctaaatgcccatcaatggattaatggttaaagtgtggtacatatacaatatggaatactatttggctagtatagtatgaaattctatcatctgcagcaacatgggtggaactggtggtcattgtgttaagtaaaacaacccaggcagagaaagacaaatttcacaggttctcactcatgtgggagataagaaatttgatcacaaggaagtagagagtggaaagagagagaacagagactgggaagggtgagtgggatggctaaagagatgtgacgagtacaaacatagttattcggttggagaaaagtaatggcaaaaaccgcaattacttttgcatcaacctaatagaaggaatgaattttatgtttcatagcagattagggtgcctgtagttagacaaaagcatattttactcaggtgatgaacaccctaagtacccttaatcactatgcattatatacatctaacaaaatttcacaagtactgcatacatttgtaaagataaaaaatattttaaatgaaactttgaactttgcaaaaaaagaaaagggttgcacaaataatcatatagtttcctcaacaattaggttaaacttctctcttgtcttttctcttcacccccaacccatacttgagagattttataaatgattcatatagtttaatatttatctgtgatcttctggaaaggctaagctgtggattatgactactttagccttaggagctctcctttgattttaaagtatcttcttacccatcaaagtggccacaagctagttacagttgcagtaagcaaaattgccctaaaaaaagaaagaatggactttcttagtccatttgtgttgctataaaggaatacctgagtttgggaagtttttaaagaaaagaggttttttgtttttgtttttttttttttttttttttcccccccaaacttttaatttaaaaaaattttttttttttttaaaggttttttttttaaaaaaacccaaattttaagggtacatttccacattgtccaggttattaacatatttaaacatttcccagccgggggtgccccccccacaaacttttaattaaccataaggtatatcccccaatgctatcccccccccctccccaaaccccacaaaattcccaaaattttaatatccccctcccaatttccatttaatcccatggttcaatcccccccaaaaattaaaaatacccggtgttgggtttccggttctcgcaaaattttacggaaaataagggtttccaatttcacccatttcccaaaaaaggaacaaaaactcatccttttttagggcgccatattatcccagggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaatattttgggattatttggaaagggtaaggggtggataaagaataaattagcactaggagggttcccttggattttaaggatttttttaacccttcaaaggggcaaaagggtggtaaaggtggcgttaggaaaaatggcccaaaaaaagaaaagaaagaaatttttttgttccattggggtgggataaaaggaaaaccggggttggggaggtttttaaagaaaaaggggttttgggtttgggtttttttttttttttttttcctctctaaatttttattttaaaataggtttttttttttttaatgtttttttttttattatactctaagttttagggtacatgtgcacattgtgcaggttagttacatatgtatacatgtgccatgctggggtgctgcacccactaacgtgtcatctagcattaggtatatctcccaatgctatccctcccccctcccccgaccccaccacagtccccagagtgtgatattccccttcctatgtccatgtgatctcattgttcaattcccacctatgagtgaaaatatgcggtgtttggttttctgttcttgcgatagtttactgagaatgatggtttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccatttcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgcacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagaacaaacacattcaaaagctagcagaaggcaagaaataactaaaatcagagcagaactgaaggaaatagagacacaagaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagcaaaagcctttgacaaaattcaacaacccttcatgctaaaaactctcaataaattaggtattgatgggacgtatttcaaaataataagagctatctatgacaaacccacagccaatatcatactgaatgggcaaaaactagaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccttgtttgcagacgacatgattgtttatctagaaaaccccatcgtctcagcccaaaatctccttaagctgataagcaacttcagcaaagtctcaggatacaaaatcaatgtacaaaaatcacaagaaaagaggtttattgggctcatggttctgcatgctgtataagaagcatggtgccagcatctgcttcttgtgagggcctcaggctgatttcccttgtggtgaaaggtgaggggacctggcatatgcagagatcacatgacgagagggaaggcaagagagagtggagattctaggttccttctttttttttttttttctttttgagacggagtctcgctctgtcgcccaggctggagtgcagtggcccgatctcggctcactgcaagctccgtctcccgagttcacaccattctcctgcctcagcctccccagcagctgggactacaggggcccgccaccatgcccggctaattcttttgttcttttagtagagacggggtttcaccgtgttagccagaatggtctcgatttcctgaccccgtgatccgcccgcctcgacctcccaaagtgctgggattacaggcttgagccactgcacccggcctccaggttccttttaacaactagctttccaggggattcttgtgggaactgatagagcaagaactcacacattccctgccccagggagggcattaatctattcatgagagatctgttcctatgatccaaacacctcccattagtcaccacctccatcactggggatcaaagttcaacatgagatttggaggggataaatcaaactacagcatagatcaatccagaaagtatataaaatctggctttgtaacattaaactggcatccatgtattcacaggggctgagcccttttgttttgtggatgtactcttgtgatgctgtaatttgtaatgttaaagaatatgactctcacaagcacatagtcattttacgtaagtcctctccaagtttgcttcctctgaaaagatggcaaacgaacttttcttgctctccacactctgctgtgttctaagcttcttggagatttttgtgtaagcctcaattaatgaatgggttctcctcaacttatgatgggtttatgtcctgataaacccaccgttagttgaaaatgttgattccacgtcaaaaatgcatttaatacacttaatttactgaacattattgtttgcctagcctatcttaaacttggtcagagcacttacaccagcctacagttgggcaaaatatctaccacaaggcttattttgtaatacagtgttgaatatctcatgaagtttattgaatgctgccctgaaagtgaaaaacaatggtttgacaccattgcaaggacaaaaatcattaaattgaacccatcattagttggggatcatctgcatgttttaatcaggctgagatttggatgttaaccccaatacctggttgcttggaaatgtggcaacttcacccagaaaaacagacacgagacttttctaaccactatgatcagtgtttttgtaacttcattaattcatcctgcagattcttttctgttcaaattcttctgtgtgtatccaaaattggcataaacctagtccagttccctgggaattatcttattttttcgttaaggcagcacaagtacagaaagaattatggattaccttattggatttctccacatttatgtgaaattcatctgcatcagtctgtttttttgccttttttaattggtaattcaaactgatttccaattctccgttgaactatgttatcccgttctctgaacagagtggaatttatgtacttctgtgtactcccccttcatgtttatccaatggataagtgtaacttatccttttgactgcagcataatttacatgaagaacatttaactacccattgggctctttcaatattaggaaagattatttcactggatttctttggaagagaaaaatcctctaaaatacatgtcatcctttttgttgtctagcaaatattctctctcttccttctccttctatggtaggagtgtaatattaaagttgggcttggacacatgactttgtcaatgaaacatggcagatgtgacagggcacatgtttctatcaatcctcatgtactcctgcctgcattatgaaatagtatgtcttagttggtagctgctctttcatcctgggactttaaataagaaaacacatggaggctgttctgaaactgacttattacctggagagggtccacatagctgacctgcagaccagcctgtgcaaaacgaatacttgtggctgtaagcctctgagatttggggttgtttcttatgaagcatttttacaaggaacatttgtccagtgggaattcagaattgttctggatcagtgactactatgtgcctctcatttttcacctgtccaaatggggttgtttattgctgtcatccttgtgttgtttcacttttgtatgatgtatgtatgtgtgtgtgtgtggtcataaggggatgtaaatagcttttctttttacctcatcggtgtctgaaacagtacaaaccatatctggacctgctacagaagttagtacaagatcctggacttcaaatctaatgtcttttggagaattccctgagagagggtatgagtacattttggacacagagggaaggagcactaatatttgagatcaagagcgaggactatgaaagattttattattcagcaaataatcactttctcttcatcccctattggaagcaaacactattgaggcccatctctgttgttttggccatatgacttactccgaacagtggaatgctggaagaagtgggtgtgctcactctaaaggaaggttttaagaggcattgaaagtttctgccacccttcttgcactccagcccttctcataatagtagcacaccctggacaggctggagtgcagtggcatgatcatagctcactgcagcctcaaacttctgagttcaagtgatcttccttcctcagcctcccaagtagatgggactacagtgcacaccaccccacctggctttttattttttgtagaaacagagtctagctatgttgcccaggctgatttcaaactcctggcctcaagcagtcctccctcctcagccttccaaagtgctgggattacaggtgtgagccgctaaactcggctatttttatgaaattttaaaacataagtgtattatttgactccttgagaaggacaagtaagaaacagaattgtggacctgtttagatgctaggaggcaatatggtgtggtgaaataaatatcagttttggattaaatatttctaattctgatccgaacagcgatgatttctctgtgatatttgagaagtcacaatgtcttagaacacaatttgtctagacaatggagagtccaaagtgggcagggggacacaggtcaaaaaaatgacctatctggtactatgtttgctacttggacaacaggatcattagaagcccaaacctcggcatcatgcaatatgtccatgtaaaaaacctgcacatatatcctctgaatctaaaattttaaaaaagaaaaacatgatgtgtttcatttataaagtgaccctttaacatactgtgaaggattgctgggaaaacttgaaataatatatgtaaattgtgtagctcagtgcctggcatgtattatgtggtcaataaaagtgggagcatttgttggtagtgctggttcttgttgaggttttggtgattctcctcttttaaactctactcaggctaaggctcatgtcttcaatacactttggaaggaatctcaacacttgctcaagtgctgggtattcagtagatgtgacgggctaggatacagactgtgatattgactttctttttagaactgtgaattgtccattatgcctatggttatggaaaaataatatgcacaagtttttcaaaagaaagaggagtgtagtcaaaggttattattagcagttcaacactgcgataggtgttgtccaatccgctgtacacaggtctcctttagagccaatgtcttgtttaaaaaataaagcaagctaagcatgtaatagtggcacatcgagaaatgctttatgtgatacagagtgtacccgagtgctgactgaagtagttatgaagctcctgggcaggccaaatggcataatagcagcaaacccatagatctaggcttcttacatggtaaataacaaggtaggtcaggtgtaccctggggaggaggttttggggatctgagttcctgcatctgagtcttttccattgtatatatcctttccctccttgttggttggttttagtattaaaacaaagactatcccaggttctctgcaccctaaaatctggaccagcccataggatctggtccaaccacatacttacctattaagaataaaacaattgtaaaagtgtaatatttctattccccccaaaaaatcagaaagtaaaaagcaagttaatctcattagctttcaggataataaattattttactaattcactctctctctaatctcatgatatttctaaaatattttaactgttatgtgatatcttcaaaaacatataaggaactctgaaaaagaaggagggcatttttccaaatttcttacttctcagaatatataaaaatattcaaaagtaaaaagaatgattcttgaaatctgaacttgaggctttgttttattatataatgcaggagagtgatgccgctggctgagtctgggaaagtttacagaattctggtctgaggatcatcccacaaccccctcccctaccaagacctagagtctgggtgttcagattgggcacttggcagcagacgatgatctagaaggcaatcaaggaaagtggctattaaaagatcacaggcttactgaagggagaaaaatgacttttgctaaaagctaaatctctgaatatccccgaagctattttttctcttgacctatatgtgtggccctgtgtatgcatagtcacaattttcacctgatttttttttgggtgtggggggtaatgatctttacacacatttaaatttaacacttgctaagccacttaaaggactgagttaaataagaaatcacttaagcaatcttggattcttgccattccttgtgatttcatggggaggggggtaccactcgtaggacagaagccaatctctaattgttttatttaattagatcatttcaatagctaagctagcctgaagaccttgtttctctgtgtcctctcaccttgattgggttgctttgttcaagcctatttctctagaacctttgtactttttgaccatggaattgatggggtattagctggggtcttcacatattttagcagaggcatttctcaggttgcttctcattttcccttctcctctgctccatgatatatgaaaattgattatttttgccttcctgcagccaagtagaaggttgtaagtcactatgaatctataaaagctgtcacctttcagtggtggtgcatttgtgatattttctgagggctaagagaatgggtgttcttgataaatacttctccctgtcacctaaaagacaaaaaaagaaagtattccactgtcaatttatcataaacttgaaatgtcaatggaaaacagcattttttggttgcacatgaaaattacacatggcattactttgaaagattgaatcttctgaaactcatcaagcaataactgctccacacattcagggatggcagtgtttttcttcctcttctgtcagggaatgcattacagaggtgatgtgagtctatggcttctctgagcaccaataagaggtccaaatgaatgattggaatgcttgcaacttggctgaaccaaatgtgatgagttcttgttctcacctatttttaaataactcctaaatattcaaccaaatgtaatttaattgcatttacatattggaagctaagcaatgggtgaataaggccaaatccttagcaggatgctaatgggatttggaagttcaagatccctgatcaactctactagcttatttatgatggaatcacagatgtggatcacaggtcaagaaaggttggtcagttgtctgagggagcatttctccacaattctgccccatcatttccatacaaactaaggttacaccctataatttgagtgtggtctgagtctactaggaagggggccctggaccctaaatcttatcttcattagatgtcagagttagatggtaccttactcaaaaacgggcccaactcctacatcttaagctgtaagatttacccaaagacatacaacaaagcaaagtggttgcagattctggtgcacagcttttacccacaagtccattgtcacgttggttttgttttgttgtttgctttccctatctccactctgatcctaattctgaccataagtttcatctgcgattttgcacaagtcaggagtgacttgtgggtgaaggcctgtgtatgagtgggatccgcactcatgcatttacttgcataggtcctgcaaggaaggacctcagcctcaacagcatccttcagagcagccaactgcagtgatccttttcttatccgtccttattacttatttacataaagagctgccatcccttaactaataaattttgagcctttcttgtaaatctggatggcttgccagtgtgatggcagtgcaaaagtgatttccccagagggcaggcagtagacagaaagtaactccgcctttgttagggaagatatatgaggcttttagctatctgcaaatatggtgaaattggacgatggtagcagcatccaatcaccattccagttcctctctgccagaaggacataatgcaggagtcagtatatggttccatgcccaaagatgcaaaacagaaagataatagcatatgtttgctgagacttgaagccaggtattgcattaagcattttaaataccttattccattttaaaatccttactatagcctgagagggtgagtattattaaaatgaccattttgcaattgagaaaaatgaggccccaaaaaagctgatcctcttgtttaaggtcttaaaattagaaacagaaaagctggcattgaacatgggctatttgaccccgaaacctacggttgtagccatcacactctgacatgagaaactgctaacttagggctctaatttcatgcaagcccagaaaaacagtgtattgaaagaaaactggtaccaacctgtgggtacggtgatgtgtcttctagtcccaggtcaccacgcactgaccatcaatcttagggaagtcatctgttctctgcagcccaacctttgcattctcatctgttaaatgagtttgggacagtttggtttctaagatctcttctagttctaactatctggagctaggttgtaaccaagccaagggcaggagacacatcacctgattctgagttaaacccccacaggacatttatatgaggtcagtgttgatacctccacatgactctttatacagaacagttcacaaaacatgacttatagactgtaccataaaagggcttttaggaagcatttaattaaagccccaattcttttcttaatatatgatgcttactgaaaaatattagatgtaaaattaaaaaaaaaaccatgaatctcattggtaattctaccacatttcaaatatatcacacttaatagtttggtaaatatatttccatgccaccccctgttttggtactaacatatgcaagtatttttctaaacaaaaataaagtgataatatttaacctgcttttgactcccaataaacagtgcagtttttttctgttaatattctaaaatataaaatatagtcatacagggaggggaacaacacacactgggacctcttgagggttggggttgggggagggagagcagcagtaaaaatagctaatgcatgctgggcttaatacctagattatgggttgataggtgcagcaaaccaccttggcaaatgcttacctatgtaacaaacctgcacaacctgcacatgtacctaagaactaaaaattaaaattaaaatatcaccataatggctgcatagtattccactgaatgaaagcaaaataattggcgttatctttgctcaatagagcaaaacgagttcatttttaaaaattgttttcattttttattatgaataacttgacagatattcctagagttaaatacatactaacttcaatgggataaaagaaaatgaaagaaatgctacattaaagacaatgcacttttaaaaagattttaggtacatactattaaaatctctacagaaaggtttattagttgtcattttacccgttagtataggagagtgtctatttccctaaacattcatcaatattacgtactatttttaacaagtattgccaaaccattgctgagttctcagggtgtcttcaaggcaatttaacatgatggataaaacacagcccctagaggcaggctggaactggggctctgctgtttgctatgttgtgacctttggcaagtaacttaacatctctgtgtctataaaatggagactttagtaacatgaagggttgcatgttatatatgataacatatagagaggaagtagaatgtaggtaagagatattttaattgtgaattactattctttaattacaaatgaatttgagcacttgaataagtttgctaaccatttgtttctctttttctcaactgtagcttgctgtgtttagcccacttttatattcaaagattctttttcttttcttaactttataagaaggttttatatgttaggaatattactttttgcctttcacatgttgcaaataagccccatattttcaaacaagcaccctgagacccagagagattaagctctgtgtcttctaatgttccatccaggtctcttaatttgcttcatttttcattcatttgttgtcacaaagcttttcctttttgttttttacttttggtgagttgtcgattttattcctctttttttcttcatgttcaatccaaatttgaacttaaataaatacaattacaccttgttaacaaaggcctctggaagaaaagtaatttcaagaaaattgtaaaattgacttattacttcagatgttgagctctatgtgtcttttgtgattctgttcacatcctctgaagtctgttctaaccatacctgtctgttttccggttatgccaggcaaaattttaagttgaatcctgtgatggttagtattgattgtcaacttgattggattgaaggatgcaaagtattgggcacttatttctttcctgtgttcttatacactttgtcatatttagataatgcacttcccttgcattattgaaattgtctttatgtatgttggtctctcagcaaactgtgagttccatgagggtagggacaatgtttcttttgcttttctgtcctcagagcctaataggcatttggagaatggcaaatcagatcccttatatcaggatgagaattagcagaactatatgtccagaagctacctgaggccttctgccagctacatctgccataggaagttataaaagcaattaagtgttcatacaactctaaacttaaccatgctacagtagaggtgattaaaaacaacaacaacaaaaaaaaacttaagcactgttgatgaaaagagttgaactctgtaaattatttgaagagatttattttgaaccaaatatgtgtgaccatgacctgtgacacagccatcgggaggtcctgagaacatgtgcccaaggtggttggggctcagcttggttttatacattttagagaggcatgagacatcaatcagatacatttaagaaatacattggtttggtccagaaaggcgggataactcaaagcaggtgagggagcagtggggagcttccaggacataggtgaatttaaacattttctggttgacagttggttgagtttgtctaaagacctggaattcacagaaagggaatgttcaggttaagataaagattgtggagaccaaaattcttttgaagtcttatggtggctgcccttagagacaatagatgacaaatatttccattcagatcttagtcagtctctttaggattgggagggtctggaagaaaaagatctagctatgtttatagagattctttacagatgcaaattttccgccacaaagaaccactttacagggccatttcaaaatatggcaaagaaatatgtttgggggtaaaatatttttattttcttccttgtctcataatgttatgccagagtcagtttggaaagtaagtcacagtatatagggttaaataaaacccgtctaaggagaatttacgatttgtagggcatgactccccacatcccttaggaatttgggcaagaaaaaaaaatcagagtttagtcctcagcacatagaaaaatcatctgacttctattatcttccactaaatcactaaatcttgggcatgccatttgatctctctgcatcacactctctttatctgtaaatgaaatattggaactaattgaaatgcctctaaggccagtgttttaagttccagtgttttatagttctataaggcttcaaactagaaaccacatatatttgtgtttttatttttttttaacttttaggttccagggtacatgtgcagtttcattatataggtaaattgtgagtcacgggggtttggggtgcaaattttctcatcacctaggtaataagcacagtacctggtaggtagtttttcaatcctctccctcctcccaccctcaagtaggccttggtatctgtccccttctttgtgtccatgggtactcaatgtttagctcccacttttaagtgagagcatgcggtatttggttttctgttcctgcattagttcactgaggataatggcctatagctccaaccatgttgctgcaaaagacatgatctcacccactcttttttatggctgcatagtattccatggtgtgtatgtaccacagtgttttgtttgtttgtttgtttgtttctaatctaatctaccactgatgggcatttagattgattccatgactttgctattggagatcacatatttgaaagagaaaagcaagaaataaacaagaataggagtgaacccatgttcactagatctaatgatctgtctcatatacttgagggagttccttattcaatggagacaaacaaaagaacaacaaaacacaaaaataattataaaaacatcaagatagccttcaccccataggattgtatttatgataacaattcttaatcttctattaacggggttaaaacattctttactctgcacagctgttctgtagcttttaagatatggcaaaaattgcaaaagaatcctgaattttaaaggaagggataccaaaatagtgtgcatattatggctacagaagcagtggctttggtgcttttatttggagctaccatcatttccacttagctcatttctgtatgaaaatgaaactaatcagcttcagtgcatgaaaccattagctactacttcaaagtgctgcttttcacaaaggtcaaagagggcccacccagcagcaacaggaattttgcaagtgatgtgtgtcacatttgcatatgataattagtttctctataaatacaatttgttctgcagattaacattttgtgtcctcattagatagcaaacatttccatattaaacccacaaagctgccagcgttggctctgcttgcattgcatgatagcattaatacctttgtttatactgatgccaattagtagtgctaagtcttggaagaataaaagagatcactaatgctattaatataagtagtaataataatgttgagaagctttcacaaaccttgttaacttcaaagatcattagcagtaaagtaccactgggttgtaaatggctgcgttcttggacacataaagtataagcatatctagaatgctctggtctgccttctcctggcttacaacaatgccagtcttaaatgatttgcatgctgtaaacaggagcaagcaattaaaacgttgttttcttttgctaaatgcatttagttcaataaggaaaaaggatgtgctctagccagaagaaacagcagtttgctcaacttgtgtagctcattgcaacacagtttgctgtcatttaccaggccaacttctctaaggcggcgaggcattttatggttccataaaaggtttttataaaacaagatgacctggaatttctcaggggaggatttagttttcactggaccagagtggcaagttctctgaggaggttgttgagggatatagaagacggtgatagatacatgagagatggggtggtggttgtcacctgttgcattaatcttttaatactgagtagaggaggctgtgtcagacagatgctcccttgtgaagtgttagttctgcacctgaaagggctgcacttacatgaagactagtagtcattcacccacagttcagtgacaaggtatggatgatcatatagtcactgttggtaagcacatttcttacagtaattaactaacttcatttctcggcctgtttttgttttgttttgtttttgagatggagtctcactttgtcgcccaggctgatgttcagtggtgcgatcttggctcactgcaacctccacttcccaggttcaagcgattctcctgcctcagcctcccaagtagctgggattacaggtacatgccatcatgcctgactaatttttgtatttttagtagagacggggcttcaccatgttggccaggctggtcttgaactcttgacctcaggtgatccactctcctcggctccccaatgtgatggtattacagatgtgagccaccgcacccagccttcctgcctgttttttgtttgatgtggtgtatatacttagattcagcaattttaaaaaacattgattaaagcaccagttaatcaactgcgatattcaaccaaaatttaaatgctttaccattggagtttgggctgggacacagagcccaaactaaattttactaaaatgcagaattttatatcatttcagaagtcaggctcacagctctgctattactagctgggcaattttggatgagacagtttctctgtcttaatttcctcatctgtgaaatggagacgagaattgtacatacctcacaaaattatcatgaggattaaatgagctactccagtggtaacacaatgcctggcccaaaaaacagactccagtggatacaagctattgttctcagttttgcatacttaatatttcctgatgctgggggaacaacagttacaaaataacatctctcttggcagattgataagaactccagtcttcctcaaatcttacccaggaggcgtcacatgtgccagacacagaaccctctcctctcagctgtgacctgagttctctattctcctgcctctagttgtttcttaaatatcacctgtcactcagatggtgtttccttcaccacttccccatccttgcacctgccttgctgtggagctaattttgtcttatccaatatgacatgatattctgccattgtctcatcttatgtggtatacagcatcactcaagtttcagaagagtgtagtcttatattttcactgttgaccaaagatttctgtaaccttggtcttttgttctcactattctatcactccaagctttggcacaagttccttgtgggaagaaaactggatccacataagtagttgagtccatacctccaatcattcttcccttcttatgcggacctatggccctgaagaatgacttgtggttggtgatatggtttggatcccatgttcagttgtaatccccaatgttgggagtggggcctggtgtgaggtgactggatcatgggggtggatccctcatgtttggtttagcaccatccctttggtgctattctcatgatagagttcttatgagatctggttgtttaaaagtgtgtagcacctccccctactctctctccctcctgccctgaccatgtaagacatgcctgcttcccctttgccttccaccaatgattttaagtttcctgaggcctccccagaagccaagaagatgctgccatgcttcctatacagcctatggaaacatgagccaatgaaacctcttttttctataaattaccttaggtatttcagagcaagaatggactaatgcggttggttagctagttaatcattggcttcgccctttagcccttcatacaggaaatacacaatggtatacaatgaatacccttcaggtccattcctgctgttcatgtttcaatcctcaatgtgaatatctggaagactcccttgctgagatttctgctgtatgtttctgggtgtgaaaaggaaccagggacatttaatatacaaaagaggaagtttagggaggccatgttaatttctctaaatacctgaaggactgcccagtggaaagaaagattaatctgcttccgacaaccaagccaatagatggaggttataggaaaaaaagagatgttagctaacaagaaagaacattctaatgatcatagctgcacaaggaggcctgctctgggagaaaatgagctctttgttttagagatattcaagcaaaggctaaatgataactggcaagatggccaacagaggggattcatgcttcagataagagttggccttgagcagtgatggctgtaaatttctctgtgggagcatctttgggcaccaactagtatgaaaggactactggcatttaagggagactttaataattgccttataattatatgttacacaatgcttcatataaaatgaagaagtaacagttatccttatcaaagcacaaagtgataggccgaaggtcattgctcattcattctacaaatgttcattgaacctttattatgcctagaaaagcagacacgtttctaggttttggggcaggatattgagcaagacaatgtttactctcttgagcaggcattctagtaggagacagggataggcctgtagacaaaagaaaaagtagatacaagtcaaggtagatatcttttaagacactccatcaacttatctttttaccacttcatctagggttcttttttccatgagtctctgctacaccatcctccaacactagtacagtcagattaaagggaaaacagctgatagacaataaattaagtctctggtcctgaaaaatgtgatgagtggatttctcctactagctgtttctctccttctctagattcaacatggaagagtaagaaccctctcattcacatgataaatactaaataaatacacaatgaaaaaaatagactgtattaccaatggccataataatacaaatatttctctgtattactcaggagaaaaagaatgtaaaattatctttttagatcaggtgtccatcgagtccctatgaaatgtctgtaaacgttcaaggtctaagtcgtacatttcctttggagtctctcatgaaactgaatcttctaaaccccccactgcttcgatcacaaaatagattcttggaagtgaaacaggcctgctaaaaactctcctttaagcaatgaaggatgtaaggaaactggaggagtttcaaagaataataacaagaatgattaaggggctgagagcatgatttatattgaatgattaaaaggattaaacatgcagaacttggccagtgctacacacttagttataaaaaacatcagaatcaagtgccaaagctctcagctcccatgaaaaatacaaatttgcatatgatttggcacatatttctaagtgaagttcagcagatctttaccgaggcagcattcatacaatgccaaaaccacttgtctggtcattttaaagtacagcctggtgatgtcagtaaaaacttgctatttgacttcattgaatagacaattaaaacaaaatgtgcccacccagggctgccatccacatgtgatgcatccataaagtatataaaataatgtaacacataatcatttactgtattagtctgttctcatgctgctataaagaactgcctgagactgggtaaatgataatggaaagaggtttaattgactcacagttccacagggctggggaggcctcaggaaacttaccatcatggcagaagaggatgcaaacatgtcctttacatggcggcaggaaggagaagaaggagaactgaggaaagggggaagcccctataaaaccaccagatcttgtgagaacttactcaccatcatgagaatagcatggaagaaatgcccccatgattcatttacctgccaccaggtccttcctatgccacgtggggattatgggaactacaattcaagatgagatttgggtgggaacacagccaaaccatatcatttaccctagagtcacaaaccaaaattcctacagatagcagacaggcaatcacatgagtgaagtgggctaagcataaagggtgcagggcctatgggttccagccaatgtttccatgtgggtattttggccaagagctgacagatcttcttgtctatcagatgacgccagtgattaagggtgctttcagcagcaagtaatgaaagagcaacacaaaaagggggagctggtggagccagttaccctagagctgcatatctccagagtaggaagaggaactactgggttaggaggagggaatagaaatcgatgtgaaaaggaaatcaagtggtagtcattagaatttaaaaatccatgttgttaatatttttaaaaatccactgacttaaaacacatggacagaaataccattctttggatattagcttgttgccacttatctggctaacttctttgttttagagctagaaaatagatccagggaaagggaaaaaacattctcaaatgcatagtaaatgtagatccagggaaagggaaaaaacattctcaaatgcatagtaaatggatcatcagaagaactgattagaagcagtggcctaggaaagaatatctgggttcttttctgattttgttgtcggagtgatttacttctaggttcataactttgaactttcttttcaattactttttattgtatagacaacataaaattttccatcttaactgttcttaagtttataacccagtgatgtcgagaaatacattgtgcaaacatcaccaccctccatctccagaaccttttttatcttgcaaaaatgaaactctgtatgtataaaacagtaagtctttattccctctccctgcaaccccagacaaccaccactctactatctgtctctttgaatttgagtactcttatgtaccccaaataaatggaatcatattttttttgtgattggcttatttcacttaccatgaagtcctcaagatttatctgtattgtagcatatgtcagaatttccttcctttttaagactgataatattccattgtatgtatataccacatttgctttatccattcatccatcagtgggtattaggttgcttctacctcttgtgaataatgttgcaatgaacagggtgtgcaaatatatttttgagatgctgttttcaattattttggatatgtacccagaagtgggattgttggatcatgtagtaattttacttttaatttttaaataaacctccatattgttttccatagaagctgcaccattttacattaacatgaagagtgcacaaggattccagtttctccatatccttgctaatgcttgcagttttttgatagtggccattctaatgggtgtgagatgatatctcactgtagttttaatttgattttcctgatgattagcaatgttgggcatcttttcatatgcttgcggaccatttgcatatatttggaaaaatgactgttcaagtcctttgactgtttttcaatcgcattgtttggtttttgttcttcagatttagaacaaaaacagaattctttatatgttctagatactacccctcatcagatacttaattgtatgtatttttttcccattctgtgggttggctttttactctgttgatagtatcttttgatgcacaaaaatttgaaattgacatgaaggcaatttgtccattttttcttttgttgcctgtgcctttcatgtcatctctaagaaatcattgtcaaatccaatgccatgaagactttgccataggttttcttttgagttttatacttttaggtgttacatttaggtctttgattcatttaatttttgcatataatatttggtaagagtccaatttcattcttttgcatgtggatgtacagttttcccagaaccattagtttaaaagactatcttttccctgttgaatgatgttagcctctttgttgaaaataagttaaccatatttgtgcaagtttatttggggattttctgttcaactccttggtctatatgtctgtatttcttcaagtgccatactttttttgattactgtagctttatagtaaattttgagatctggaagtatgactccttcaactttggcctttttaaaagttgttttagctatttggggttcttgaggttttatgttaatttttggatggatttttctatttatgaaaaaattatgattttgatagattgcattgaatctgtagatcactttgggtattattgacatctatcaatattgtcttccaacccataaacagagaatatctcttcgtttgtcttctttaatttctttcaccaatgttttgtggtttttatttacaagtctttcagctccttggataaattaatgcctaagtattttattctttttgatgctattgtaaataacattgttttcttatttttcaattgttcattgttagtataaagaaatgcaactgatttttgtgtgttgactttgtatcctactacttcactgaattcatttatttctatttttttggaatttttaaggttttcaatgtataagataaatcatctgtgaacagagataattttacttcttcttttccaaattagatgccatttacttcttgtcaattgacctggctagaatttattgtattatatgcactagaagtggtcaaagtggccatccttgtcttcctgacgttaaaggaagagttttcagtctttcaccatttagtatgagatttgctgtggggttttcatatatggcttttattttattgaggttatttccttctattcctagtttgtttagtgtttttttttaatcgtgaaactatttatagtttgtggagtgttgattttgaaaagtgacttttctgtgtcaattgaaataatcatgcacgttttttcttcattttgttaatgtggtgtattatgttgatcaactttcctatgttgaacacattcttggattctgggaataagtcccagctagtcattgtgtacaatcctcttaatatactgctgaatttgatttgctagtattttgctgaggagttttgcatcagtgttcacactattgcaataagcattgcattaatgttcatgatctgtagttttcttttcaatgtgaattctgttgatcattcaaataatcaagctttggtttcattgattttgtctattacttttccatcctccatttcacttacttccatgctaaactgtattatttccttctgctacctttgagtttagttttttttcctagttccttaagttgtaaagttactttgttgttttgagatccttcttgatttttaatatatttacagctataaattgtgtctttagcactgcttttgctgtgtctcataagtattggtgtgtcccaaaaatatgttccgttttgttttcattgatccccaagtagtttccaatttcccttgtggtttcttctttgatatatggctcgttaaagagaatattgttaaatttcacaaaaatatgcgaatttttcagttttcctaactgtaacggatttctaactttatcctgttgtggtcagagaagatactttgtatggtatctattttaaaatctattgggatatagacatatggtctatccttgaaaatgtcctatgtgcacttgagaaaaatgtgtatgttgttgagtacagtattctgaatatgtctgttagatatagttggtttattgtgttaattcctctaatttctaatgcatcttctgtctagttattctgcttgttattgagagtggcgaattaatgtctccaattattggaactatctgtttcttcctttaattttgtcagtttttacttcacatattttgatggtctgttattaggtgtgtaaatgtttataattattatatcttcttgctatagtagatcttttatgaatgtataatcttttttgtctcttgtaacctcttttgatttaaagtctattttgtctgatattggtatagccacccctgctctttttagattactgtttacatgaggtattttttcatccttccacttcaatctattagtgtctttggtgctagtgagtctcttgtagctagcacatggttagatcatgtttttctaaaaatgtattttgccaatctctatcatttgattatggagtttaatcatatacatttaaagtaattactggtaaggagggacttctgtcattttgttatttgttatttgttttatatcttttttggtccctgatttattgcattatagtattctttgtatttatagttgatttttggtagtgaaatgttttaagtcccttctcatttccttttctgtatgttttataggtattttcttcgtagttaacatgggaattaaatataaaatcctgaagttataacactctaatttgaatttataccattttaactttaataatataaaaaactactcctttacagctctgttcccatccctttcagttgatgtcacaaaattacatttttatacattgtatttccaaaacaataaactaataatattttaagccattagtctcttaaattatataaaaaacaaaatgtggaattacaagccaaagttacaataatactagcttttataattgcccatgtatttatttatcttaactgtgctctttattacttcctatggctctgagttaatgtctaacgtccttttgttttgacctgcagaactcccatcagcacttcctacagagaaagcctagtggtaacaaactccctcagcttttgtttatctgagagtgtcttaatttctccctcactttttaagaacagttttgccagatataagattcttggttgaaatttccttttcttttgcactgtatcaaccactgctttctgccctccaaagtttccaatgagaaatctgcagataatcctgttgtagagcccttgtatataatgaatggcttctctcttgctgcttttaagattctctgtctttggggtttgcagtttgataataatgtgcttaaattgagtttgttgagctcctcagatgtttacgtctctcatcaaatttgggaaacttttagtcattatttcttcaaataatctctttttccctttttcactctgctatccttctgggactcaccacaatgcatatgttggtccacttgatggtgtttcataggtgtcttaggctctgttgacttttcttcaatcttttttttttctgttcctcatacttgataattttaattgtcctatcttcaagtttgctgattcttctttttgctcaaatctagctttgaattcctctagtaaattttttatttcagtttttatgcttttcagatccagaatttatttttggattctttttaggtttccatctctttattggtatttctattttgttcatatgttattttattgactttatacatgtcttcctttagttttttgagaatctttaagatagttgttttgaagttttgtctagtagatctgtcttcaggtcttcttttgggaaatttctatttatttttttcttttgaatgaaatatattttcttatttcttcatatgccttgttatttcttttctgtcgaggtggccatttgaatctaataatgtgctaactctgaaattcggacattctttttcttaatgtttgctgttttttctaaattattattgttgcaggctgtttctgtgccaaatactggtctaaggcataaaattaagaccttctcagatattttctgagcctatgttttcctctgtgcatacacactgactttctaattttcctatatatgcggttgcttttgaatgccctagtcctccatgactggctcaaaaggggaaaaaaagagaaaagtaaaagcgaggagaaggcaacatcccttcaaatcttctggaagtcactttagtcagaaggtgaggggcttgcaacaatgggggaggtatgacaagaatggccacagactctgtctgtgcttctgtaatcagaagcagcaattagtgatcagaacacacatctacagtatttgaagaacacagccctttttggccactctggcttccgtactctattaagacccttagaaggaaaatacccctaagaattgtataattataatttcaacatgacaggcacatatatacatcagtgtacatttacatgcaagatagacatgaatgaagctttaataaaagggaagggtttttaaaataatttttataggactatctaggttggttgagtttgtgcactgcacaattctaggggcttcagtgtcaagtgcacattcaatttgtggcaccgagatgagatatcaggtgaaccctctgagccatgaagttggggggaattctattgttggaatgctgagatatcacagcccaaccatctaaaaatatatttgcctaattgccaagatttccttatatgttccctgcctacttgctgctacaatgacttctagagggagagaatcagagaagagttctggtgacaaaatggaaagtggttatacagcttcaaaaagatagaatgttcattctgacaggtaggacacaactttgagtaaggaaaagcagttgccattttcagaaaaaaaggaacatttggactaaacaccctgaaaaattttgacagcaagaattatgagattggggaaatatgtagtaaaggaagtggtggaaaccccatccctagagccatttgaaagtcaacgggataaggaagtagaaaatctattctaagaaagaatcttccactgcttcccctgggtctgacagatgacataatgggtctcctccatctctgattgttacagttctcagactttatgtattttccagggttttataatgttgctgttagaccaggctgcccacctccctctaaaaagaaaaaaaaaatcagactccaaacaaaccctaaactagttgctccaaggagtgcaaagatataccaaatggaaattgtgaatcataaaattctctagtgtgaatttcattattccctgaagatagtctaccaagatgagagacgttgtcatcattttactttatttatctgtttttctctttctggtacattttcatttcaggagagaaaaaccaatgggacagcaaattctcatagaactggctgaaaaggatctgtatttttttcttgctgtccacttattttccaacaagaaccctggctgtctttgtgatgactcaggaagaggaggatttgtgcacagccaagaggaaataggacctccatatttgccatttggatgcagagaatatgaacagacttctctgagacccaagaactgaagaaattgttgggtcctctcagtaaagtgggtctaagaagcatgtgtgaatgagtgttggttgggcatgcaggtgttgttaattgtgtttttgctcttttttatacatatctttgtgttatctacttacagttatagactcagatatggaagaaatctgagtctcactcagacaatttggggtttcattcttttttatatgtaaaatctaagaaataccctagtagttaagtgactcgtctgcaccgcccagttttctctctgtggcagcagctccaagggtaatctagtagcaaaatctagaaccatggcaaaaatgcagagagagaaatatatattttcatggaatcagtatacaacactaaatgtaactggccttttgggaaaaaaaaaaaggagggggcggtggaaacctggtctaacaatcgtctcagccctgtctggattgtggaaaagggcccatagcccaggcgctcttccatgattacatattaacatacatgcatgttggaaacctactatatatataattgctttatgtccacagtagattttaaattctttttttttccctagcaaacattcttctagagactctcaactttaatttgaaaaaaaggtaaaatctcatttgtcttgatgagggctacagtgtacccctagtgaccagatattccatactgaaatcattgctgtttctaactccagggccagtgaatctaggactagtgttgaaggggagagtgcagaatgaagaactattttccactcagttttgcctgtttacattttactactagaacctctcctttattgcttcgtttagaatctggattagcaaagcgtcaggagctttcatgtttatcacacaatttaaaatggaatgaaacacacaccatcacaaagcccaggtgttggattagaatttttttttttttgctttaaaaatggtttttatttctatttttattttatttattttttcttcaactttcattttaagtcccagggtacatgtgcaggatgtgcaggtttgttacataagtaaacaggtgccatggtggtttgctccacagatcacctaggtactaagccaagcatccattaactatttttcctgatgctctccctgcccccacccccactgaaaggcccccgtgtgtgttgttccccaccatgtgtccacatgttctcatcattcagttaccacttataagtgagaacatacggtgctcagttttctgttcctgcgttagtttgctgaggatagcatcttccaactatccgtgtccctgcaaagaatgtgatctccttcctttttatggctgcatattattctttggtgtatatgtatcacattttctctatccagtcaattattgatgagcatttggatcaattccatgtatttgctactgtgaatagtgctgcaatgaacatatgtatgcatgtgtctttataacagaattgtttacattcctttgggtacatacccagtaataagattgctgggtcaaatgttatttctgcctttaggtctttgaggaatcactattttgtcttccaccgtggatgaactaatttatactcccaccaacagtgtaaaagcatttctttttctctgcaaccttgccagcatctgttatttattgactttttaataatggccattttgattggcgtgagctggtaactcattgtggttttgatttgtatttctctaatgatcagtgatgttgagctctttgtgtatataaattgtgtgattccaactcagtgctgtctaaccctcaaccctccttgccctcctctcttccgttccccttcagaaatgtctgaatccagtttttcttcagaatactttctccaggcaatgttggaagttttctttccaacttccagtcttttctgctctgtcttgatcaataaacgtgttcttttgcttgtagcctagggccaaagcctgtgtgttaaagtgatgttgtcacaaaatgcctggtgatgtcataaagcactgggagatctggcaaaagcagcaatcctcatttttatgtccccagaaaattattggtacccaaagggccatcacatcttctgtctatgcaccagttgttgtagaaatagtgaaggcctagttaacttcgtgcatttacatgtttgacagatttctataaaagactgtgtagagaatatagatttaaggagccgaagttattaaaatggggtggggtgagaggaactaggccaataaaagcagacaacgtggttttttaatcctttccacaggaattcaggcaaaaggggaataaaataattctacagggtcacttgtaattcagcttaaactaagctcaggaaactgaataatatttctcagaaggctgatttatgcacttaaagtaactaagtcccaggtgtcataggaagtaatacaacatctagcaatgtcctagcctgcatgctcaaactagctgcctaaataaatttctaacttctctttaaaacatttcagagtgagttctactgggattgctacagccctagattctctgttagaaggggctgcctcagtaagaaaagcccagggacctaggtaggttctgcattataaacaaattgtgttccaaagtttgtctgtgaatcatttctttggaaacctaaacatattttctttacagaaacagaggtagacacagttaggctccctggctttcataaccctccaaagtctatttaaaccatatgcaggtcaaatcccctctgctacataaaaactagagaataatcacttaatcacacaaaccaagggagaggagatcagatttaataaatgttttttttcatttattccctcccccctccatttatcccttaattagaagagggtaagtgatagatggaaatttggtggatgtcctgacggagatttccaacactttcaaggattttagacgccaatggcacagattctttattaactaattatgcataatttatcttttatgacagagaaaatagcaaggaaagtggctcagcagagaaaggaaagggaaatacctagcaatttctatgggaaaaaaaaggccctttcagggtaactgttattgctatatcaggacatcttggaagctaagtgtttcaaagtcaaatgtacttggagccatgaagcttcatttttctctttggttccagtgacctcacttacccaggtctttattaggcatgctaataaaaagtaaaataaaaacagttttggcagtctatgtcttttttttccctcaaaaatgccctgaagtggtggtacagagtggaattaacacatcctaaatgcaggcagtcggaaggagacagaagagaaacaaagggctggataccccacatactggataagaagagcctgataacggagttgactgtatttggaatttgcctgtttccttctgtaaaggagacagggagctgaatgaagtgcttatctaagaagtgtcagaacccttgcgcaatgttgttacaaggatgttagtaaagcagggggaacgttttggcaggtacagatgggattctgtttgacggaatgtattttcttgctatgtgttaatctgtgctcttctggtatcaagcccttaaggagtttggataaagcctttagggaacccacctttaaccctctctttagtatacattacaaggaatttagcatcccatatgtgacacggatggaactaaataattgcagtggggtgttgggagaaaatcaccctaaagcaggcaactcctgcctagaaattatagctggagaaatctggctaagcaagaaatctctggaatattccacatgagactaagggataggttgatggatttctaacaggttacacccaactccaagtgagaagtcatttgaaagagtcccagctggacgtcacaggcccctaatgagagaacacaatgaagccagtatatccacatgaaaaagttgaattcaaagaggactctaagagggcctagacaaagcagtttggagtttcagaggagcaaacaccattccataaggtcttcaatcttaacccactgaaacaatgtaaaagtcttctcttccctctatttaagtcagagcaagtttttagcagaatttaaactcaaaagatgaggaaaaagaccacattccacaagagtaactaaaatgatagtaaaagagaagcaatttttgtctccataaaaataaccttggagttgcagttcacagcacctaaaaagcacactaccatgtacttagcaccaaaggaatatcagatgaagtgagatttctaaagtaatgcagatcaagggcaaagggaatagctcgtggtcaagaacaaatgtaaaggaatgacatgggtaactacagaatcaagagagtcacccagagggaaagaaaactcattggaatatgtgacgggcaggaattagtgatgaagagagaataccaaacaagaaaagggagacgtggggcattgagaatggatggcaggagataagctactctattccctgtgggtttgatcttccctgataaagaaaattgtgtccaaattcggaaggataaaataaacactgtaaaggagaaactgaagcccaagataggtgaatcatttcaaaaggcatctagctcctaaaatacatgcaaatgtttaggtctagatacatttgccctaaactacaaagaaaactttgcagattgaatttatttttttaattacttaaaaataattagagggggagccaagatggttgactagatgcagccaggaagagcttctccctcaaaaagagacaagactgcccagtagactggcacactctgcacagatctttagagggatggcattgagagtggacagtgggaggacatggaccgtgggctgaagggtggggaggggaagctgggaacctcgcacaagattcctgagcgctaggactctttcctggccctgagcaactcctactgaaaaggtgagtgaaacaggtgtggagtggcccactcttgtaatggacctctggtatcctagccacaggagaccccaagacccccataaacatctgagctggcaggaggaactgcccaaagagttggcagagacagaactccagcctgcccatagccccaaaggtttggcatgggagtggctggagtagagagtacggccatgggcacccattccccaggcttgccatattcttctaggtggttctagcctttgttgactgtctgacctgggcagaacagggctgtcttgtccctgggatagggacagtctgacctgagcaccccctgtcttccagcctcttccagggtccctgcgtggccacatctgcttgcagtgcagcctcagcttgccagtgaccactgccatatctctcttgccagcagaccctgcctaacagagcactttggcagatagaccccacccgcacctaccagcagccttcccctgccggagcacacttgcttgcagcctcccctggctgctccactagtgcacacacgtgcatcaaaccccacctccctgccagcatgcatatacttggggacgcctaccatctcaccagagtgcttttgccagcatctcctgtcagagtgttgttgccagcagactgtgaacaccttgatgcctctagcacagcaggtgcttgacttggagggaccagagaacaaagttgctggcctggtgccagccctacaagattagagcatgtagtctaggaatactgagctgagctttggccccctgaaagcattcagaaatgaagcccatcaactaaacctaacttatatcatgaccaaaccctcaagggcgcaaagaatataaaagcaaaaggcttcatttgaaaggcagcaacttcaaagattcaaagaacatcagcccacacagatgagaaagaaccagcacaaaaattcctgcaactctaaaagccagagtgttgtcttatctccaaacaactgtactagttccccagcaatggttcttaaccaggatgaaatggttgaaatgacagacatagaatttggaatctctatggcaagaaagcccatggacatacagaggaaggttgaaacccaatctcaggaaatcagtttgagttgaaagatgacatagccattttaagaaagaaccacattgaacttttggaaatgaaaactgcattataggaatttcagaatttaattggaagcactaataaccgaatagattaagctgaggaaaatctcagcttgaaggcaattccttcaaattaatggaggcagacaaacattttaaaatatgattttaaaaatgagtgaaacctctgagaaatacgggattatgtaacgaaaccaaacctatcatttactggcacattcctgacaaagatggagagagagcaagcaacttggaaaacatatttgaggatactgtccatgaaaatttccccagtctcactagagaggtcaacatgcaaattcaggaaacccagagaacccctgccagatgctatacaagatgacatagagtcatcaagacacacagtcatcagattctccaaagtcaccacaaaatttaaaaattttaagggagctagagagatggtgcatgttttctgcaaagggaaccctattaggctaacagaggatctttcagcagaagccttataggccagaatagactaggggactcatctttaaaaaaagaaattccaaactagaatttcatatccaaccaaactaagctttataagtttataaggagaacaaaatcctttcagacaagcagatactaagggaattcattaccaccaggcctgccttacaagaggtcctgaagggagtgctaaacctgaaaatgaaagactgataacccgccaccacaaaacacacaagtaaatagaccactgacgttataaagaaacaatacaatgcaagtttacataacaaccagctaacaacatgatgccaggatcaaattctcacatatcaatattaaccttgaatgtaaatgggctaaacaccccactaaaaagacagaaagtggcaaattggataaagaagaaagacccggctgagtgcagtggctcatgcctataatcccagcactttgggatgccaaggtgggtggatcactagagtccaggagttcaagaccagcctggccactatggcaaaaccccatctctactaaaaatacaaaagttagtggcacatgtctgtaatcccagcttctcgggaggctgaggcatgagaatcacttgaacctgggaggtggaggttgcagtgagccaagatcatgccactgcactccagcctgggtgacagagggagactctgtcaaacaaaaaaaaaaaaaaaaaaaaaaaaagaagaaagactcaattgttagcctgttgatgctgtctgcatgagacccatctcaagtgcaatgacaaccataggctcaaagtaaaaggaagggaaagatacatcaagcaaatggaaaacaaaagaaagcaggttgctattcttcagacaaaatagatttttaaaccaacaatgatcaaaaaggataaataagagtattacataatgataaggagttcaattcaattcaacaataaagcttaactattctaaaggtatatatacctaacactggagcacccagatttataaaacaaggttttgaagacctacaaagagacttaaataaccacaaaataatgatgggagacttaaacaccccactgacagtgttagatcactgagacagaaaactaacaaatatatttgggacttaaacatgacacttaaccaaataaacctaacagacatctacagaatacttcacccaacaaaaacagaatatacattcttctcatttgcacatggcacatactctaagactgaccacatgctcagccataaagcaattcttgacaaattcaaaaaaccaaaatcataccaaccacactcttgtaccgcaacccaataaaaatagaaattaatgagaagaaaatctcccaaaccatacgattacatggaaattaaacaacctgctcctgaatgacttttgggtaaagaatgaaattaaggcagaaatccaaaaattctttgaaactaatgaaaatgaagatatattgtatcacaacctctgggacacagctaaagtagtgttaagaggacagttagcactgaacacctatatcaagaagttagaaagatctcaaattaacctaacatcactctagaactgaacaaagttgtgacacaaaaattcatacaaaaggtcaatgaagccaaaattgatcatctaaaagtataaataaaattagtagaccactagctgattaataaagaaaaagaaatccaaataaacacaatcagaaataacaaaggtgacatcaccactgatcccacaagaatacaaaaaaccctcagacactattatgaacacctctatgcatacaaattagaaaacctagaagaaatagataaattcctgccaacatacaacctcccactattgaaccaggaagaaactgaaatactgaacagatccataatgagttttaaaatttaatcagtaacaaacctatcaaccagaaaaagccctagaccagacacattcacagctgcattctaccagacatataaagaagagctagtaccaattttgctgaaattatttgaaaacatcaaggaggaaggattcctccctagctcattctatgaggccagcatcattctaataccaaaacctggcagagacacaataaaagaaaactttaggccaatattcctgataaacatacatttaatgctcctcaacaaaacactaacaaatcaaatccagcagcacatcaagaagctaatgcaccacaatcaagcaggctttatccctgggataaaagatttgttcaacatacgcaaatcaataaatgggattcatcacataaacagaactaaaagcaaaaacaacataatcatttcaatagattcagaaaagacttacagtaaaattcaataccccttcatatctaaaactctcaacaaactaggcactgaaggaacatacctcaaaataagaggcatgtatgacaaacccacagccaacatcatactgaatgggcgaaagctggaagcattccctccgagaactggagcaagacaaggatgcccatgctaaccactcttattcaacaaaatactggaagtcctagccaaagcaatcagtcaagagaaagagagaaaaagcatccaaataagaggaagtcaaactatctctcttcacagacactatgattctatccctagaaaaccttaaagactctgcccaaaggctcctagaactgataaacaacttcagtaaaatttcaggatacaaaatcaatgtacaaacatcagcatttctatacaccaataatgtccaagctgaatgccaaatcaagaattcaatcccattcacaatagccacaaaaacagtaaaatatctggaaatacatataaccaaggaggtaaaagttctctacaacaagaattttaaaacactgccaaaataaatcagagatgacggaaacaaatagaaaaacattccatgctcatggattggaagaattaatattggtaaaatggccgtactccctaaagcaatttacagattcagtgctacttctgtcgagctaccaatgtcacttttcacagaattagaaaaaaatattctaaaattcatatggaaccaaaagagaagcctaaatagccaaagcaatcctaagcaaaaagaataaagttggaggcatcacatgatccaatttcaaattatactgcaaaggtacaataagcaaaacagcatggtactggtacaaaaaccgacacataggccaatggaacaggttagagaacccagaaataaagctgcatgcctataaccatctgatcttcaacaaagtcaacaataacaaacaatggaaaaaggattcgctattcaataaatggaggtgggatatctggctagccatacgcagaagattaaaattgaaccccttcctttcagcatacacaaaaatcaactcaagatgaaggaaagactttactttaaaacttgaaaaacagtagaaaacttaggacatacccttttagacgtaggccttggtaaagatttcatgatgaagtctccaaaagcaattgcaacaaaaacgaaaatagacaagtgggacctaaaaaagagcctctgggccaggcgcggtggctgacgcctgtaatcccagcactttgggaggccgaggcggttggatcacaaggtcgggagatcaagaccatcctggctaacacggtgaaaccccgtctctactaaaaatacaaaaaattagctgggcacggtggagggtgcctgtagtcccagctacttgggaggctgaggcaggagaatggcatgaacccgggaggtggagtttgcagtaagccaagatagtgccactgcagtctggcctgggcgaaagggtgagactccatctaaaaaaaaaaaaaacaaaaacaacagcttctgcagagcaaaagaaagtataccagagtaaacagacaatccacaaaatgggagaaaattatttacaaaccatgcatctgacaaacgtctagtatccagaatctttaaggaacttacacaaatcaacaaaaaataaacctaatacaaaatgggcagacacgtctcaaaagaaggcatacaagtggccaacaaacatatgaaaaaatgctccacatcactaatcatcagagaaatgtgaatcaatactacaataagacaccatctcacaccagtcagaatggttattattaaaaagtcaaaaaataacagatgttggcaaggttgcagagaaaaaggagtgcttatacacggctttggggaatgtaaattagttcagccactgtgggaaacagtttggagatttctcaaagaacttaaaatagatccagcaatctcatcactgggtatatatcaaatgaatagaaattgttctaccaaaaaggcacatccacacatatgttcattgtagcactattcacaatggtaatggaatcaacctagatgcccatcaatggtgtactggatgaagaaaatgtggtacatatataccatggaatactatgtagccacaaaaaagaacaaaatcatgtcctttgcagcaacacagatgaagctggaggccattatcctaagcaaattaacacaggaacagaaaaccaaataccacatcttctcacttgtgagagctaaacatttaatatatgaacactaaaaggaaaatagacaccagtgcctacttgagggtggagggtaggaagagggtgagtcaaaaaaccagctatcatgtgctatgctcattacctgggtaatgaaatagtttgtacaccattccacagtgactcacagtttacccatgtaacaaacctgcacacgtatcccctcaacctaaaacgaaagttaaaaaattaaaaataattttagtaataggaaagtacaaagaaatatacagggaggctctgtgcaaatttcacccagcctctcccagtgtttggagatacaatttttaaaaccactgacgttcgtttttgagaatttgtagagaacagcaggaatggtaccaacaaatcaaatgatgaacaaacattttcagaattttcaaaagtgttgagaaggtagtttctgaaatctattcttttgtggtaatgttagagatgtctgttaaattctagaaatggttaatcaatttttggattttttatgatgcagccatactaggaaccagaataatctcactgtgaacaagttggaccatttactttttttcgagaaaatttcttgactgataaaccaaattactctttgtctacattacatctgttttgtctagcatatttaaaaacctcttttattatacatctattgacaaattggttttaactatagtttagttagatgagttcatagcaagatactaacgaatcaggatcaaaatggaaagtctgtctaacagtgtgtcacagggctttgcacaaactagtgatgactgaacaaaaatggaaaatgactttgatttttggaagactaggttgaaaccaccacgatgaattttgattcttttaaaagaaccatactatagaactacaaggtctgagaaaagcgctttaatagcaataattgtaaaaattttggagttctagttgatatttcaatatgaatcataagtggggaaaaactgagtaagtttagccattatgcatctatcgcaagagaggataaagtcacactgtagtttgcactgtcaaaacctacctggaatatcgtgatcaactacaggtcccaattttaagaaggacattgacaaatcattactcacctaaagaaaggtggagccagcaatggtggcttatgcctgtaatcttagcactttggaaggctgaggtatgaggattgcttgagtccagattttcaagaccagcctgggcaacaaagtgagacactgcctctacaaaataaataaaaaattagccaggcatggtggcatgtgcctgtagtcacagttacttgggaggctgaggcaggaggattgcttgagctcaggagttcaaggctgccatgagctatgatcacactactgcactccagccagggtggactctggttctaaatttaaaaaagagagacagagagaaaggtaagggttttggatacactttttaaaaagagattgaagcagctgggtttatcatagttgtcttcatacatgggaagggctatgatgtcatagattagaataattctctgtggcctaaggtgtagaaatagtcccaaaacatggaagatgcaataaatactcttaagttaatctaaggaaaatattttacaagctagagacagaggcatcatatttcagcagatcaattgatttgagtgtttgaaacataagggaaagatgtggaagaaatatatacatttgggaatcggcctatagtttaaatgatacaactagagagtgtgtgtagatcagatgttcacttcccaggatatatttcatcctagggtatctttaatcagctacagggaagccacattttatttgtatgtgcaattctccagggagatgatctctaattaatagttcccagtgttctaaagatcccataaccataaaatttaaactttccttacatgtagtcagacaaaaaaaaacattgaccaacaaaagggcacttgaggtgcactaacttaaagtgcaggtagaggaatgagaagaaacaacgagagaaccataaggacaactgtgtaaaaatacagtgacagaattcaatgaaaggaaatttaatggtgagagtgaacagcagtttgaatgctttggaaaggtttcacatgacaaaactcagaacatgcctcgaagaggtgagacatacatctcaaacaaggtaaatgatatgcaaagcaacaacacaagagctgtcaggaagccaagtggcagaccaatttaaaataaatggtgcagaaaaagctgtgaggtcagaagaaggaaagttttagtggagagagctgaaggttgaaggaaacccttgtacagatggtcgaacataagctagatttgcaagtcattacacttgttattttattccaatgaatggtatttttatagttaaacttctttcatcttattctgtctcctgagtaaaaacacatccttcacagaagtacctacatgtttgaggatgactattacgtctctctcgaccttcttgcctctaatttcaagaattctttccaatgaagagccccacagaacttgattagaagtcaggatttgacttgagaggatatgaagagcctcttctagattctgtgtgagttgtatcatgaccccctgaaaagtttcaagaatagcattttgcatcacaatatttcatgcagaaaagactgggaaaaggaaaatgtaagtctcttatgcttggtctctggccacagcagtggaaatccagaggaaggggcagacctgagaaacactggcaaggaaggattgcagagcttggtcatgaacaggatgcatgatggctgagatagcagagattgaactctccttcactttgtgacggttttagcagccccagtgctcagacgggtgcaacttggattaaagaccagcattcagttgccacatctttttattacacaagcagtacaggcctgtaaaagacaaccatggaagggaatatgaaaactacagagcaaggaatattaaaagaatcttttgactggattttgttttctggtttctgaaatgaaagtgaaagtgtccaaaaggatctaaggtgtctcttacagagtttggttcagaaaatcctctaaggattagcttaggaagcccaaggaactgtgtgtcaatcctctgcctatctgttgtttgtcattgttgtttgtttgtttgtttgttttttgagacaaggtctcactctgccacccaggctagagtatggtgtgatcacaggtcaccccaggctcaagcaatcctcctacttcagcctcctgagtagctgagactacaagaacacactatttattttttttattttttatttttttcattttatttttagttttattttgtagagacagggttttaccatgttgcccaggctggtcttgaactcctgggctcaagcagttgtcctgccttggcctcccaaagtgctgggattacaggcatgaaccaccacactcagctctctgtccatctctaaatgggaacaggagaataaagaagtgggggaaaaagggacacttcactcagaagaaagggcactaattatctggcacaggtatctgaaatgaaattgacatttgttgagcctctactagggatcaggcacttaatgtaccttgtttactgtcttggttactaatagtccttggaaagactctttttcctatggagaaataaacagcctacctgtacaggatgcatctgtcctctctcagagaaataatgtctcaagaaaaagaatcatgagactttaggggaaaggctagtttcagaatataatctgtgcaaaaacgaggttgaggttagaccttatgagcaaagcatatttgttcacagtggatagaatcataagagatcctgtggtctccttcctctatgaagataatgtactactgtcattatgccatccttttaaaacaaggcacccaggcccaggcaggagagcttggaactatgatggcaacttgcttcctgctctgtgatacctcctaccagttttctccaccctgcaagtctccgccagagtttgtaaacctggagtaccagtggcatatttcacaccctgacttctacattttgcaggaatgttggaacgatttctactgtgcattctcagtagaaatcaacttgcatgcactgacttatttgacctccatatatctgacattttccatcccagttgaaaagacaggactactgtatatcactacagtttcctcagagtccatgaggaagactcagtaatggcagagagtgggtaaaccaccttctctcagagatgtagcacttgaaagaggttgcttgcttccagagcttgctggaaaataaatgtaggtatatcctttcatgctgggtggatttagctgcattccccagaagactaatatttcttctgagggttattttcttgaaatccttatgaatgtttgaaaaggggtccctatagagaaaactacctcagtcacatgcacaagggcctctgaattatgttgcaatttctagtgtgaatgctatgttagagtgcagtatcatgggtgacgatgaaaatgcacccaagtcaagaaatttaaatttatgatttcagcaacagtcttaacttttcccactctcgtatgctcagtgctttatgttattgtagttccagtgaaatttatgcctcagtgtgcattgcaagtgagttatggctactctgggaatgttaattttgcatttcctgacttctgtgtgttcaaagggacaagctttcaaaactggcctacaaaatagcacaccagaccagctgatgctgtgtacctccctgtgcctgtggaatgggagtgagaagacctcacggctgggtcttctttgtgtctattcctaggtctatattttacaggagcatggctcaggtggggaatgtcctgccttacatgggcattcaatccaggcaagaagtatgaggcaatggaaaaggaagatcacatggattacttgttatttcctcttctttttctttttctttaaagacagggtcttgctctgtcacccaggctggagtgcagtggtgtgatcatagcttactataactttgaactcctgggcttaagtaacttgttgttattgatagctatcatttattgagcacctactctatgccaggaattgttctaaatgtttcacttttgtgtttcatgttgctttttatcaaccatttgaggcaggttttatcatcccagcactgagtgagatagacagtcgtaagtttgctcaaggtcacctgactagtagagccagaattcagatctaatttttttttttttttttttttttttagatggagtctcactctgtcgcccaggctggagtgcagtggcatgatctcggctcattgcaagcttcgcctcccgggttcaggccattctcctgcctcagcctcctgagtagctgggactacaggcacctgtaaccacacccagctaattttttgtatttttagtagagatggggtttcaccatgttagccaggacggtcttgatctcctgacctcgtaatccacccgcctcagcctcccaaagtgctgggattataggcgtgagccaccgcacctggcctagatctagttttactgaccacaatgtccatgctctacctggggcttgcctctccagtccccaagtcctgaaatgcaatttcagctcagccctcgctagctgtgtaattttcactaggcctttaaccttggtttcttcattggtgagacaaagaacatgttggcataagtaggatcaaatttaattatgactttgctattttcattgctctctgttaaggacatcaagcccacaattgttggttcagccaaagagaaagggccaagaaagaaaggtctatctatatttatcattggttacatgctaatgagggccagcatttttgcctgttttgttcatatttgtccagtgcctcgaggagtgcttagtatagagacattcagtattgtttgttgattgaataaattatttccattatgccatctctcaccccacagtctctcttctgtttcctatcatcttgggcacagttgtgtgttctggacgttggacattttctgtcttctttcaaaaatcgtcttgcccaatcactacagcaacttactttctgcttaggaactgacatcttgctccagaaacaatttagtgtttctactcttgggaatttgcaaagcaacagatgttttctgcatactgtatctaaacccacagcaatttgaatagtgagacttcctgatactgtgccaggctctgaggaatagattttggagacagatatttggcacccctaaaattttagtaggcctaggtccagcctcgtccatgtcagtggcagttgggccaaattcaccgagtcagacattcctgccctcaggagaccccaccaccccacaagctgtggtttctaagaagcactgaagtttgtatatccagcacctttgcaattgtgttagtaacttcttctgccttatgaagaagttttctgaaatgccttaccctttctgaaggagcttttcaggttccagacattaattcttgtgcttctaggtcctatagccaacaatcagcctcaatacccttccaatcatgtccacattaccatccactaaatttggggctctctgctgctttgtgatattgtcatctttttcttgctctgctggagcagatgatctcaatatcattatccttatggcaaggttttaaaattcactctttctaaaatgactcattggcactcctataaatggtccattgcctctagctcatgaggtctcactgcactcttcatttcttagcaaggctgacttcctcccagaatgctgttcttgctcctgataactcctagactccctcactcctccccttcccagttccctaagtatacttgctcagttttgttctgacattaaaaaaggcaaggttatgaaactagtgaggaagtaacttttagtggtgaaaacaagaccttgaggtataaatcacaactttgccacttaatatctgggtgagagggagcaagttgttattgctcttttagacccagtttctcatctgttgagctagacaacaatgccctttttgtggggattggtctatcattggtaagtgcccattgaatgtttcttattcctagtgaataagagtcatactgcagatttcctggaagaagtattttattgacaataaaaaaataataaaagagctgtcattcagattttttttaaggggactgaagggggaagagactgcagaaagaaatattgtcataattgtgaaagttactgtgtttagtaatttgactttctttgtaatcaataaagtaaagaaacatattttggtttttcagtgtgtttttgagtgtgtgtgtgtgtttcatttgagcttaaagtttctttttcttgtcagaagcagtaaattcattcatccctttcaacaaaattttagagaatgcctattgtgtgtcttatactctgtaaagtgctgactaatgcagactcccatgcaggcaaaacagaaaatcacaatgaatgattataattgtgacaaatgccaccacagtgtctcatagagagttcatttttgcggcctcctgcttgtgttacaggaaatggaagcatttatgggagatgttctgaaggggatttccccctggctcttctccctgtcagaaggggacatctcctttgaagtgtctcatattatgggaagacagagctatccagaaagcaactagctgaagcttcaggcagttgtagggaagggagggcacttgggattgttgtcctaataatttaaagaaccctcagaagatttcaaaagccagggagatgtgtgccatgaatatgaagccagttttttggtttttgatttttgttttctccacgcatttgcacagatgcagcagggatggatgacgggtggtgtgatgtcactagtgaatgatatcaaaggaaagagctctgggtaatcaccagggctagtctatttatctggatagacttgtttagacttgtttaagtctaaataagtgttgttcgttagtttgttctggtagctgaatatatctttggaatctaagattctatatgcacatatgtacatacatgtccctttacggggattccttgttcttcagctaaatgccatctaacaacaagctaattgaaaacagtctcagtatctaggtcagtgaattaaatggattccatgccaccacccatccccaacacaacacacatatacacacacactgacacactgcagatacattctttcttttttcttttttttgaagatgagatctccctctcttacccaggctatagtgcaatggtatgatcacagctcactgcagcctcaaactcctgggctcgagtgatcctcccacctcagcctcctcagtggctgggactacaggcaagcaccaccatgcctggctaatattttacttttattttgtagagacggggtatttctatgttgcccaggctggtcttgaactttgggactcaataaatcttcccactacagcctccaaaagtgctgagattacaagtgtgagccacccgccatacctgtctcagatacattattttagcaacctttcctcgtttaatttttgcgatagtccaaattctaaatgttctgcttaatttttggacattgtgtcaaaccatgtgtcctgatttggcacttacaattatacaatctttccatgaatattaaatctcagtatttctctaggacattcaacagtttctttagtggcattgctttgctgtcccagtagtcctggttttctttttgtccttggtagcccccatcaactctgcttttcaatattccctaatgaaatacctctccagggattggtagttcccaccctgatgtcaccatctgaccctagagacctaaagtagtgttacagtgagtaaggtcggagtatgacaagacaaccctctggaggtcatcccagttctgtagtttgtctccaggtccttctcatgagtggatcgtgaatagccaggaaagtagaggttagctattcctatgatctgaagttctccaatctaattgtgaatcttgttgtgccaccttgaatgagtcacccaatcctctgtggctcagaggattgggtatcctctgaaaaagggggatacgatttgtaccagcttcatggtgttgctgcgaggatgaggtgagttaatacatttaattagaccagtgactggaaaatagaaggcacgatataagtatcttcttttaatgttattactgctactatcactactataatttatcagtattagtagaagtgctaaggtgcagtgacacaagccctcttagaaagctcatatgagcacaggaaggaaagaagagagaaagtaagaaggcaactttaacaaagaccaaagcactccttttccctccacactgaactacaggttaatgatgaggttatcatgacccggttggatcgcaagggctgttccagcagctgacatctgttctagaacctatccttttttctccttgtttgcctctgcttgtatggtcacctcaccccgcaccacattgctagctgtctctctttactctgactcagccagcaggcatctcaaaactcaacacagggaaatccacagccaagcatcacaactttatctcttgtcttttcttctcactctttgtggtacaacgttccttccaatgcagttgtgggtctctattaacacttctgtggctttctccccaccccatcaactctgtaaccaatcactacatatgcactgtaatttaggctggaatctgagctttgacttttaccaagaaattatgtatttctaaatattggcctttggttctactacttgggtctaaaggacatgttcacatatttcctgtctattcagatgactggtaacttgggtgattaaatgtttttcagattgttttattttacttaaactctaacctccttctctaatgcttgaattatttttttttcaagagattggccaatttgtgtttggttgtctagggaaaaaagtgtctgagagcgattagatgaagccaacttgctttcagaaaatgtaattttcttaagatactagagcatgatgacttcctttctttgacacaaatatgccttatctagacctactaatgagattaacctagaaaatggacgtgcaaaatggggagtttgttttaaactttgacatacaccagttgaaaaaaattctgagaaatttttaactaaaaaaaattcaagccaggtacagtggtgcatgcctgtaatcccagctactcagggggctgagaagtgatgatcacttgagaccagtattggaggccagcttgagcaacatagcaagagcctttctctaaaaaagacattcaagtggtaacagagagcaatttagtaaaaatcattacattcagaattttcaaatataaaaagaaaaaaagaaaatgctagctaagggaaaataaaagcagcttgcagtccacagtgactgccagtgtcaagcaggaacttcattggccttggacagggtgttctagatgtcacagtgtcaggcaatcaacagacggctgtctgataactgtaacttttgccacagtccctggtcacagcagctgatgtgaaggatgtatgatgaaagtgtgtacattattaggaatgcagaagttagaacagccaaatgctaaatggcaggtggacagacaaaaaaaaaaatgtgcttttattctgttccaaggtgcttaattttggttaatcctttgctttctactgatcacacacaaccttcttcaattctagacaccattgcatatgggcacttaacacttttaaatatactatgtattgtgtcttacttattttattttctgttccttatcccccactactgttgtgggaagtcagggaccccgaacggagggactggctgaagccatggcagaagaacataaatcatggacatttattagttccccaaattagtacttttataatttcttatgcctgtctttactgcaatctctgaatataaattgtgaagatttcatggacatttatcacttccccaatcaatactcttgtgatttcctatgcctgtctttactttaatctcttaatcccatcaactttgtaagctgaggaggatgtatgtcacctcgggaccctgtgatgattgcgttaactgcacaaattgtttaaacaatatgaaatctgggcaccttgaaaaaagaacaggataacagcgatgttcagggaaaaagagaaataaccattaggtctggctgcctgagagctgggcagaacagagccatatttctcttctttcaaaaacaaataggagaaatatcgctgaattctttttctcagcaaggaacagccctgagatatagaatgtgtggctaggggtaggtctctaaaatggcagctttgggaatgtctgtcttttacttttatagataagggattaaataagccctggtctcctgtagcactcccaggcttattaggacaaggacattcccgcctaataaattttggtcagaccggttgtctgctctcaaaccctgtctcctgataagatgttatcaatgacaatgcgtgcccgaaacttcattagtaattttaatttcgccccagtcctgtgatctcgccctgcctccatttgccttgtgatattttattaccttatgaagcatgtggtctctgtgacccacaccctattcgtacactccctccccttttgaaaatcactaataaaaacttgctggttttgaggcttggggggcatcacggaacctgccaacatgtgacatctcccctggacacccagctttaaaatttctctcttttgtactcttgccctttatttctcagaccagctgacagggaaaatagaaaaggacccatgttgaaatatcagggctgaatttcccccgatacactacaatgtaagctcagttagagcaggggagttccatctgttttgttcactcctatatctctcacccagaatagttagtgcctggcacatagtaggtgctcaataaatattggttgagcaagcatgtgatttccttgcagttccacaaacaaaacactactcaccttaacctccaacagaatacccagattccagacacaatgatctttcttagaatcatggatcttttgagcctaaagaaactaggaggttctacagtccaatcccttaattttactgataaagaggctgaagtccagagtttcagcggattgctccagcacataacaaatcaaacaaataaccaggaatagaaattgagacttctggcccactgctctttttccattaatttcagcataaacccattcccattgctgaaatagcagtggcctcatccatcataggagcataacccttgggagttctcttgggtgaagagctccatgacactgagcctgctctgggatcgttttggtggctcatatgttttcccagtcgaagacaatgaattccatgttgttgaaagctttcattctaccttcaagtcttcagacacgcagattctcctctccctccctccaccagattctagctcaagctctactcatcccatgaagttttgccccttgaatccagcccatattgatgtcatgttcctctgctttgctgtagttgtaataggatgataaatccaaaggcctgtagaggccaatttagtaaagtaaataaagaaaactgcccagggtgagaaatgaaatcccaggatcactagatccttccacttttaaagaagctatagtttcccagagttaagttcccaccgtcactgatctctttagctttttgctccttcctttcaggaattcaaaggaagaatgtggtctccaggggcattcccagccctaccatctcccctctgggtgccctccttcactgcagttcaccctgtaractttattcacatcaccaccaaggtgattccctgacaatgtgaacctcagtgagaggtgaacagagaggactccctgctcctcctctttcagacccaggagctgtctttagccccattctgaagaccacccttttcctgtatttccatccgggctttggtcaagtaagcattcctaaatcccttagagatgagggctcttctcctttctgggtctagggstacatcattttgccttcaggtttgaattsctgttccttcagcctcatttctcactgattgcactgttttccctggagatggctttgaggacatcctggaggagccgtgctggggtgtcagcctgccaccctcccctgggcagctgccctgcctgccttcttaacctcacgttggactttcctgttttctctccctttcattcatctttgccaagagatgattcttttaacaccctgactctggatcaaattgttttctatctcctgaagcttctcttcatttgagcttctcttcacttttgactttttttgctcatcgctatttgaaaacggagctatttctacttctttgaattctgaatgttcttctaagggatccaaataaccatcaacatgtaagaaaagckgtctckgtctttctctgagttcttctctaatcactgagagaactataggatatacacagtcatctttgaaaaacccatctcttgggtagtctyttgacctcccagtccctttgtaggaacatctctgctgaagcctgtccctagcatagacaggctgttcttgctttagagcctgaaatgtgtgcgtctcttttccttgactcagaagaaatgaatttaagagatacatattgttttaatcaaaaactttttttcatttaaccagtaatacagatagtttcaagctatcatcctttctcttcttccctgggacaaacatcacttattccagtaagcaggaaagatattttatggcttcaatgacgcacattttatcaagctgtcaactaaactttgtgaattatttgtatggagtattttggtgttgatgtctgggggcaaggtcaggtcaggattgctaaagacgagactaggagacttcatcaaccagattgtgaagattcttgaataccatataaaagggtctggaattttacctagagagaacacatacatttaggtaagagtgctaggttttagaataaaataatgtgatggcaggaaggaagatgatttttaaagatagaaactaggattaggaagacaagccatggtcatggatacagaaaatagtgacagatttgagggaaagaattggcaggatttgaggtaggtgaggaaaagggagggattctatttggtgggggggatttcagatataaagagaaagatggatgatttgagagcaggatggttgctctaaaggtaaactttcagatggttctaaagtcatctctgcagtaggctatttcttcagaggtctagtggacttctcacagaccaccaggagaacaaatgaaaagtcttggtggctgaggccacctcctttccccactttgtaaaacaggaggaatataagggtgccttcatgggataactgttcacaaagctatctgaactctggttagaaacacaaagaaattataaatgtttgagttgattgatatgctaattaccctgatttgataactatacattatacatatcaaaacatcactatgtactccatatatatctgcaattttatgtgtcaattaaaattttttaaaaatctgttaattagagtctattggaaatttcactactggcattaaaaatcagagcctgtgctgctgaaatttatattctccactggtaacctaggaattgaagtgctgttcaagttttcaaaaacaagcatgaagcattaagaaaaatgcaattgtcaacagaaggaagtaaaatagaaagtagatacaactccctatgatcagcctgaggtagagtcagaccctggccaaacccacagcaaacttcataaatttaaaaataattttctaagtgcttacaaatccattgtattatgatctttttttaaaaaggaaaagtcattttatccccctgttatctaatgctatctatcatctaatagatactcttgaggaaaaacatctgttaatacccctgagcattcttcattgtaccctaaacacatgagaattccctttcgtaagtaattgaccttcattatcattgtgacattattcttattctgggaaccaagctctctgattgggagtcccaccctgggttaaccttagtccctatggttccttcctttagccaagtttttgtttgttttgttttgttttgcttccaggactctccaccatcccattcatgtacccctcccgatagggggttagtggccacacctggcctgcaaacctgaagatttaagatgcacagtgtcgctatttgaccttcatttttggaggctataggattttagagtgatagcttttctctttcaacactctaaagctgttctatttttcttttctggtttgcattgtttctgatgaggtctgcagtttcccttatttgtttcatagtattatttattattgtaaagtttcttctttcctctggctgtttgtaagattttattttatcttctctttctagtaattttattatgatgtatatttatgtggttactattctggggagtttgccaagattcttagatctgttaggttacagttttcaaaaagtgtcaaacaatttgtccattggttcttcaattttttttctccttctaccttgttttggacttcagtaatatatatgttagactaattattattgtcctatgggtcgctggctctctatttctttattttttttcagtctttttaaatatctattcctcagtttgtataacttctattgctctatctttaaatttactaattttctcttttacagtatctaatcagctgataattctgtctagcatgctgataattctatccatggaattttttttattttcataatttttagctgtaaaagttctgttttattctttttcaatcttctatttttctcattagtttcatggttattcytctaaatctatcaacatatttatgaaagcaattgtaaagtctactaaattgatcatgtctgttatttctggatctatttctgccatgaatatttctccaggttatactgaacatttttctttacatacctcaacatttttgtttggatgttgaatattaaattatcaggtctagattttgttgtcttctccttaaagaacattgaacaattttgttttggcagatacttaagtaatttgcaaatcaacttgatcctttcaagtctacttttaaaattttgttaggtcagatctaragtarcctttaccttagagttggttcagctctaatactaagatatgattcttctggagtctctcctgaatatctgagtttctaatgcattgtctctaagaactttaatgtctcccaaccctgtgtaagctctaggaatttgtcagattaaaactcaccagtagttttggcatactatgtatgacagtttcacccacacatgtccagtgtactacgggcatcaggtcaagtggacttagatgcagagttctgaagttctacttctgtatacgtktctctcctcaggtactctgtcatctgaattccaacctcctttgcctcctctaatttcagcatctgtattttaagtkaagggagaacttcctgctttacttgaatttctttccttgtcccatgatctggacatgcttctaggtagaaatccagaaccaatgcagggctcactgcatttaccttttctcatggatcacagtcctgaacttcattttatcaaagatctaaaaacagctatttcatattgttttttaatattttatttatgatgcaaaggcaagtccagtagaagttactctgatatggccagaagtggaaatcttatctgcataatgtattaaaattcaagatttacataaaaatccatatatatatatatatatatatatatatatatatatataatctctttttgaaaagtagaaagatctaaacagttctacctttcatgaaatttattgactgaagttgatttgcaagtgtccacttcttggttgaatatgcatgcccaagttttctcatttccaccaagataatgtcactcattttgcctgctgcttttattctataactacaaccacaaatttattctataaagtaatactagtcagtatttttgatcaaatgatgacaatctttccaatgcaggtaaaaaagcaaaactttaaaatgatagcattttatacaatattccaaaacatataccatcaagcgttacaggaatgtgcaagatattatggtggcacaaagatggcaatgaaacacattttgaattgaataacaatttttaagtattttgagatggcaatattgaagaggaagctatctagctacttgtttacctgtaagataaatatggtgaaaagaaattgttggaagatgcttactaatgcacagttgttggcatattgttcccaaaatggcatcgatgatgatcattaatcatgactagtttggcggttttcatccaaatcctgtcctatactctttactaaatctggatgtcctgttttggcagccccattagccttccagatccttagacttaaacctgcagtcaactgggttttctctttcttcttgatccttcctatccagtaaattgagattactgacttgaggctggatgctgtggttcacgcctgtaatcccagaactttggtaggctgaggcgggcagatcaattgaggtcaggagttggagaccagccagaccaacatggtgaaaccctgtttttactaaaaatacaaaaattagctgggtgtggtcgtgggtgcctgtaatcccagctactcgggaggctgaggctggagaattacttgaacccaacaggaagaggttgcagtgagccgaaatcacaccactgtactccagcctgggtgacagaggtagaatccatctcaaaaaaaaaaaaaaaaaaaaattactgacttgaccttgaccttcatagtttctctcctatctcttcctactctttgtattaccgatgtctatctttgctcagtccctgcttccccagctagtttccacaataaatattgccaaatattaatcttcctaatataaactggtgtcatattacttccctggttacaaaccttctgtgtttcctcatggtttataaaatgaactaaaaacttcctattctttcaaggtctaccacaatttacccacagacttgctctcatcttatttcttactattctcatttatgtatattacctctaagatatcaagaaatgttaattagagctgaaataaatatgtatcctaaagaggcctcgaatctttcaaattcctccttactttgtccatgccattgcctctgtttgatgtgtttataccagtattttatgggtccaaactctactgttactcaaaattcagctcagttactaacccgtatatatcttccccatttcccccattttaaagcttttcttttgactatgggacaactttagcaatttatctgtttgtattgagttgcaacttatcacttattaccttgtattattgttatttgcatacacatatattcttacatgtcttgataatggattatttccctgaaggcaggattcatgttcattattctgtcctttacatccccttgcatggtaccttgttggtccttgataaatattaagaggatgaatacttctctgagttctgtgatgcagtcttctaacactatcactttcattgcaagtaaatatgttggttaccagaataatcatatacatttagtattttttccttccgtttactttttaatattcacatatattcacgtttattatggtaatatcgaactctgacattgtcctcagtacaattttgtgttttataaggggcctgatttgaaaaaaagaaggaagagaaaccaaagatctgaaacccacaggctcttttcttaatcatgaatcttggcagtgagagttgcaatatgttgccacctattaattaaatctgtactctggtgaattggccaagagagagaacattaaaaaaaaaaagaaagaaaataactaagaaggatgaggagcataataagtctaggaaaccacttgagtaatcagaaactttcatgtagaaataccccggccatacctttttcctaggggctgtgagaaaactgcagggaagtctgaaggccaagaaagaacctaaaattttggctggtgagtcaccactaaaatattacatagcctcaaaacatgttaataaataacactgaaccaaaagtaagagccaattatgagcttaatcagaaacagagagtaagatatggatgaaattttagagaccatctagatttcagaacattgctaatcattactgaaaaacagatctcttggaacatctgttgacagctatgaaccctgcctttaggaaaatgcacataaaaacaaaattagtcttaggttgagatcttttgattcagagcacatttcatcattaaaggcatgaaaaacacatttcgggaagagctggcaatcagctcaagatcacataggaagttagtgacagggaggtagtgtctgaaaagtgcctacagaactcaagctcctgtcttgggattcatccaacacattttctctcatgtgtagtagcattccatgcataaagtaatcgattttatttgagtaaaacttgcttagttttttgctttctagaagggaaaccaaaataaaaatgtaatgtcttttgtgctaggcactatactgggtccttccacatgtaccattttactactcccacagccatagataatattcttatttcacaacgaggaaatgaatattaagagagattaaggtgactttcccaaatcaatacagatactataaaatagggtttagatatgaagccatagctctacctcagttttggtgatttcttttttctatgcctccttacctttcactctgctatgctgattctctgggaaggctttttttgatctggcaaatgaaataaggcttactgatactactacaacaaaaatgattgcacacatttaaagacataagaactttatatagaaaagccaccaacagaactgtttgggaatgtctgtataccttctctggcacaatttttccagttattatttgagctaagtgtacccatttctttcctccctgtttaaaatattatccagcactgaccacacagctggtagaactgttttggagaaccacccattaatatgtaccaaaagccttaaaattttgcctgcattctgtcctgggaattctacttctattaatttatcctaaggaaatcattgaccaacaaatagccaacaaatgtatgaacatgaatgtctaaaatagtttattatgacttaaaaattataatatgaaacaaactagggatctagaaatagaaaagtatggcatattcatacaacgttaaatatgcagccattagaagtgatgttgtagatatatgtttattgaaatgtaaatattctcatggtgtaatttcatagctaagggttgtattgtacctgaattattgtttttaaactctattacatgaccatgtattattgacctattattgatacatatatacattgtttccattttttaatgtactataatgatcttcatgtgggatctaggcagtgactctaccttgttcacttcttttccaaatacctttccttctaaagaaaggggtctctatgcctttactttcgtcttatgggaacttccctatgtggcaatttacattctatccacactactgataatggtaaaaccttatcatctaggttagtcagatttagcacttgaaatacaaaagagagattatgaaacttagaaacttttttccccactcaccaaaccttggcttccaagacaatttctttgctgtggaatcaaaaattctatttttgaagtagaaatctgaatattggctctttctctttgagcttctgctttaaaatcttaatttgtccccagatcaatggaggcctccacatgaataggttacaaagatatgggaaaagataaaagtatatttattcatattttagcacaccaacatggtgcatgtatacatatgtaacaaacctgcacattgtgcacatgtaccctagaacttaaagtataataaaaaaaattaaccccattaatcattaactttattgtttaatttgaaagggagaaggatctttataatgagcttttctatacaagcacatgctgtatcttttaaattagttaggtcttcttatatatcctaaaatatgttataattttcttcacaaacatacatttattatcacatttatttctaagcagcacagagtggtggttgctgttgtgtgatcttttccttctccattttattttcaaattattgacagtgttttggaaaataacttattttttaagttcatcttgtacatagctgccttgttgaaatcttttatttattatttttgtttgtttgtttttgaaacaaaacaaacagagtctctttctgttgcccaggttggaatgcagtggagggatcatggctcactgcacccatgaccttctgggctcgggtgatcctcccacctcagcctcccaagtagctgggaatacaggtgcacaccaccacatccagctaattttttgcattttttatagagaagagatttcaccatgttgcccagtctggtctagaactcctgggctccagtgttccaccagcttcagcctcccaaaatattgggattacaggtgggagccaccactcctggcagaaatatttaatcttttccaatctttttcttagacattgtgagagattcttcttttgtatgccctagatagacaatagagacaatctaatctctttctttttaataggggtttcactaatttctcattgtgtgttttacattagttagaaccttagggaaaataagaaagtgttgaagtgtagctgtgatataggataactagatcacttttttaagcttaaaaaaacccctttactataaatggctaatagtttacaattaggtgtcatgtttctgttagttatccatccaggctatgggattttctttccgttccaagtgacaaagtattttaattttaaaaagaatcagaaatgggtggtatctatcattaagataatcatgttttttctcccttagcttttggtttattgaattacatggatggatttcccaatgttcaaaccttcttatattcctcagtaaatcctaattggtcacagtatattattagatttaacttgtgaatactttggtattttgtatcatagcgtttgctagcaagactggcctatagttgggatgatgtccatcaatttctatgctttggaatagttgatgtaacataagaattacattctcctggatattttggtacactataatgccaagggagaaaagcaatttattgaccattatgtataatatgatccattcttgaaaatacaaatacacatatgacaaaatctgaaggaacatatcaaaggttaataatatttctgagaagcttcattattgttgttttttcttgctttttctcaactataatttttagtatgtctatagtggatgcagacattctgggggaaatataggagggtcaaatgttatatggggtaaaaatataaaaagcatggtagttagaagccactgattctgggaatatgctctgagctctccaagcaagagcatcttgcactaaagatttctgtgccaaactttgtgctccagataacagatccccgtttccagaacctgcacccaatatctgtactcacctccaaattttgacctggctcctgctagtctgacccttttgtagaccttctgataccagtctctttatagatactgcatttttttctgacgtttgggcatcttttggctatggcagtgccccctgtacccactgtcctctcatggcttcattcatgtggtcataactcatctcactgcctctcagttgggagctgacacttgatttggtaaaggaaacagtgtgagagtgtctgggtctcctttctttagccttatatcaagctctttctcagatatatactttgcttcatctgaattaaaaaaaaaacccatgaggaatcatggctactaactgaaatttacttttattttttgacttgaaagcaaaacagtgattttccccagtgagtctatcgatacgggataaagtactgtagcttcagagttcttatttggtctttccaaagttttatactttagagttaggattctcagtagattttccagtcatttagaaataacccagggcagcaaatatgatctgctttaataggatgaacgagtttaggctacagcacattgcagcttggggaatcctgctcaccttatctatccctctctttatggtctgcggataccgcatggtgagtattctcagaattgccaagtctgcaaacatactgccacttaaagcagtctccttggtcagaaaggtgctttctcccatatgttctcagaggactgatagaggtgtccccctggagttatgaaaataaagtcttcccttctttctagtcatttgacataaggcaattttagtctctgtgtctcatgtttaagggccttcctctgaaatctgaaaaactcgttttaaattgttagggtgttgcagtttcttaccatatttcaggcaaagttcttcccactcgggtcatcagcctcacctttgtgggattccaaattgagtggcaatacagtgtagcagttaagaaaatggactctagaatggattgcctgggttcaaaatggccaccacaactttaattgtgtttacttgaccaaattaatttttcttttttcacccttctttctcaatctgtaaaattggggaaaataatagcacctactttattatgttgttgggaaatgtaaatgagaaaattttttaaaagttctaagcaagagtgtctggcatatggcaatttgtcagtaagtgctatctcttcttattttcatcaagtgaaggtgtacccaaggcaatgttcagaaacattggctcctggcacaggagtcatgccccaacctcattgctctcattgtgcaaacacaccttccctgtccattgcagaattccatacctgctccacaggctcacagttttgctctccatagcatcagctgagaatctgaaaacaaaacatcctgttctcatagtttttcaacctcttcatcttcggtgaccttctctttcgctcatgccttgccatctgcactcataaccacactgattatcactagaaactgtatcatcttttaatttgttaattgatgctcacttcctaacacaacatccgcccttcctcttaactttctaaaatgtcctcacctccacaggacttggacctcatccaatactgcctaatgccctctccctatcattttcagtcgctgagttccttctgttcttctcctgtctccgtattcagctagattttgtgatattccattatgttcctgctcttgtccagctcatcttccattgtacctccttccaaaaatgccagctgtttgataaatctaacctccagtactcagtgctcaggacaccttaatgaaaataagggggaaaaaagctgagataaataggtagaacaagagaaaagaaaaatctctgcctaagagggaaggtattccagatgatcttgttatgggattttcatatatatatacattttagcaatctaacatgacagccttaaattgctgactcatagcattacttagaaatgaatttgaaccttggaaaactgcagagttcagtttgtaattttccaaacctcttgatctcaaattcaaaatgtaaattttataagattagacttcaaaagacttcactgtaatatagtacttaacaattattgggaggtggaaggggctgtatcatgtcttccataatcacatatttggtccttttcaaatattccaaaaagccatttgaaaatgtagtgtgtgtgtgtgtgtgtgtgtgtgtgtgtgtgtgtgtgtgtgtgtgtagtttgtattagggaagaagttagaatacaccttatgaggaaaaaagaaacaaaaaacacaaacaaatttagagaaacaaatcatattgattgttcattatgtgccgtgtctaatagtctcactatattttaaaaagaactagttccagcttaaaaaaaaaaataagggaataaggctcaagttccttttctctccatacaagcttgttttctaaactcaactcacatatttttttaaaagacacttttcacacactggataaatgcctcactctgcactgagtggtgaaatgagggcaggtcagggggagagctatgtctggcaatccacctgcctctgttaagaacttttattatccatgaaatttatctttggcactttcttttctaaataaattttccatctctgcttgcatcagaaatgaaaagactgaaaccacgttctttgccagctttttactttttatgaaaacagttagtaccttttacaagagaatttaatttgcaatggtgtcttcactgcaagtagagagaatgaaggaagataaaggaagacaaaggagaagaaatgaggatcaagagggaacagatggcaaaatagcatctacagtgtgcccagcatcctgctcagagctttagcaggtgtcagcaaactatcgcaaggacaaaaaaccaaacaccgcatgttctcactcataggtgggaactgaacaatgagaacacatggacacaggaaggggaacatcatacactggggactgttgtgggatggggggagaggggagggatagtattaggagatatacctaatgctaaatgacgagttaatgggtgcagcacaccaacatggcacatgtatacatatgtaactaacctgcacgtcgtgcacatgtgccctaaaacttaaagtataataataataaaataaaaaataaaaataaaaataaaatagaaagtaagatgcggccaggcacggtggctcacgcctgtaatcccagcacttcgggaggctgaggtgggtggatcacctgaggtcagcagttcaagaccagcctggccaacatggttgaaaccccatctctactaaaaatacaaaaataagctgggcattttggcgtgcacctgtaatccaagctatgcaggaggctgaggcaggagcattgcttgaacctgggaggcggagattgcagtgagccaagatggtgtcattaaaatccagcctggatggcagagcaaaacttcatctcaaaataaaaaaaaaaaaaaagaagtaagatgctcccccccctcaaagaagacatatggctatcacatgcaggttggcatgaaagtcaacacctccgataattcttcttttctttactgtgaaaccaccctgccccagtctcctgcatatttggtcattcaagtgcacaaataggaaaatagaacgttagagagggaaaagatcttagagcttcccctgctcctaactttatgttatatacagataaagaaactgaggctcagggatgggacacttcgaggacacagagttgttgacattgctgatttgaactaaagccttggacttctctccaaactttctgatggagcatgaaagcaagaaattacggagtaaaaattattctttctaagaaaatatatatatttgattcttctaatagatcagggccagtaaactacagcctctggaccacatctggcctgctgtttttgatagtttgttagatcacggtcacactcatagagttttgtattgacaatggctgctttcatgctacaacataattacaatgtaattacaatgtaatgatgacagcctgtatacctgcaaaggttaaaatatttgctacttgtccctttgtagaaaaaatgtttgctgacccttaacctagcttaatactttgtgaggccagggaatatcactgctttgtccaccactgtatccctagcatctagcttgatgggtcttcaaaactttgtttaataagaaattgataaattaggtcaactcaaatatccaagtgaaaatttgtagagttggataaacaatggagaactttaaagtgatctgagtgaacagataagttttagaggctttgaagattttgcagtttgaattaatttctgcccaagtgccatgtttgtgcagagtaaaggtaagaatagtacctcctgtctaacttaattctccactgtccttttttactgtcttaggtgttgcttgccaaatattcaaatttttcccatttggggctgggccatgtggctagttttagtggatgagtttaagtggaagttgagatatgtcgttttcaagcagcgcagttctttggtaagaccctccagagttctgtgttttagtcacagttaccaaaaatgctcccaatagtgaccgatctatcaacctgggcccctgatgcagaaatgggcaggcagaatggaggtcgcacctgaatctcaatgacatgtagtataagccacagataatattcctgctatatttatttgtatgctaatttttcaagaaagcaaatgtcacctccccacctaaatacaaatcccttgacaccatccaaaaccatgcttatcactcaccgaattcctcaaaacacctcttaacttgatttgaatggatcacagtcctgatacattatttattcagtctttcaataagtctttaatgatgcctactgtgtgtatggaagagattgactagttgttaatcaaacctttttccttttcctcctggacatacagtcagaccacatttcccagtctctcctatagctacatgtaatcttgtgactgacttccagccagtgaaatgtgggtagagtaattctgaatgagttctctcctggcatgtaaaaatatcctgccttgactcccactttctttctttccttatttattgattgccttgtgatgatagcagagcctccatcaggctaagtttttgaaggactgtgtggagtagaatttccagtcctttcacatccacctaccatttggactttacttgaatgaggaataaagcttttattgtggtatgccattgagagttaaggttttaactttacagctgctagcattaccttaactaagaaagcaatctgggagtgagggattacaacttttaacatatggtcaggaagttctcattaagaaggtgacactggagcaaacttgtaagagcagagggagaagctgtgtaaacatgtggagaaagaatggtctaggcagagggaacggtgtgtgcaaagtccctgaggcaaaagcacgcctggcatggtcaaggatggcagtcagctcagtgtgatttaaacaaaggatggtggatgaagtaaatgagagcagaaagatgttgccagattttacagggcttgacaactttataatacaattctagccactgaaactaggcttgtagtttatatgcccaaagggcattttttattttttatttttatttttttgagatggagtctcactttgtcacccaggctggtgtgcagtggcatgatctcagctcactgcaacctctgcctcccaggttcaaatgattctcctgtctcagcctcctgagtagccgggattacaggcatgtaccaccatacccagctaatttttgtatttttagtagagatggggtttcaccatgttggccaggctggtcttgaactcctgacctcagtgatctacccgcctcggccttccaaagatctgggattataggcgtgaaccaccgctccaggccccattgtgctctttttcaagcccatgctgaatcatatgactgcatctgagtatcttatactaaatgataaaataaatgatagtataaatgaactctccttgttataatattatgggcacacttttaggcttcatactccattttaactttcctttgcaagtatagcaaaattctgtgctcatatagattcagagaaaggagttaatacaacttaactatttcctatgaatcaggatataggcacaactaaatcatgacttttcctacaagaagggagaaaaacttaaaatcactccatacctcatacagactcataggatgttagtgattgctgtcagtgcaatgggaggtcaatatgagattttccaaatatttcattccactctggaatttgtcttaacaattgtcttttcaggtgagcttaaggtgaaaaaagataactgaatgcctgttcttctattccctaaatataattaagtcaagaggcttactggacacggccattagtattagttttctgtcatcttaatatctaaatagcataaaattaagtagtttactatagttacaaaatgaccagtagtagaaaaatgaatgagcaaatgctgcaaatagaaaatttataaaaggagaaagtaaaatgcctagtatgtaactgaaaaatatctaattggcacagtaataaaaacttcagggatgtacaccattttaaaaagtatcaatttggtaaatttaaataaatcataatgacccttttagacaaacataggaaaattgctctctcgtacaatagtggtataacaatgtaaactaaaaaaaagagagaacaatttggaaatatatactgaaattcttaaaagtatacatgattcctagctctgcccactgagaaggcctagaattaatacaactctagtggcaatgagcacaactagtgcctagatcttggttagtcaataccattcaccagtcaaagaaaccaaggctccttgaagaaatggtttattttggggctgagcagaaaaaacacaaagtaagaaacctgaagcaccccacagtgccagaaagttagaaaagagaaacaaagaatgtaggaccccaaactgaaagagttggccaaaggcagaaaacatgagaaacaaataaataaagactgtattggattgtaagtcaaagaatcaataaatgttttggatccatactaatgaccagtcaagcaagtaaccaatcatttaatggagaagaggaaatctcttacatgagaattccaagcaatgtatgcggtggacttagtgacttggttccaaagaataaagtatggaaatagaaaaattgtagctgtggaaaaatttagcagacaccactttaaccaagtggtaaagatgaagattaccagtaataagtcgtgatgacatcaggtgctctcttatatgatgcaatgagaagattaccacaactctcttccctcaaatactaataatcctagtctaataatgacaaaacatcagataaaccccaaatgaggatgttcagctaaatacctgataagttctcttcaaaaacgtcaaggtcttgtaacataaggaaagcctaagttgtcacagactttaggcgacaaaggagacatgaggactaatggaatataggatcctggattggatcctggaagatggaaggtcaatgtatggaaaaactggtgaaatcttcataaagtctatagtttagaaaaaaacattttgatcaagcagtattactcctaggtaattatcctgtggaaactcttatgatgtatgatatcagttctcaaactttagcatataacaaaatcacctgcagggactgctataatcaaatttctgggctccggtcccaaaattgttatccaatatatctgcagggagcaagggccggaaaatttgcatttctaaccagttttcaggtgctgctgctcaactgatctgggaatctcactttgataaaccctgacatatgtaaacatttgctataagaatatttactgtcataattatgtattggattacataatttttcttctcttctcttctcttcttttctttttttgagacagggtctcactctatcgcccaagctagagtccagtggtacaatctaggctcactgcaacctccgcctcctgggttcaagtgatactcctgcctcaacctctcgagtagctgggattacaggcacctgctaccacacccagctaatgtttgtatttttggtagagatggggttttgccatatagctcaggctggtgtggaactcctggtcacaagtaatttgcccacctcaacctcccaaagtgcggggattacaagcgtgagccaccgtgtccggccatttactatctttttcttattaatgttttcaaacatttaaaaatattttcaaatgcttctataatatttgtactgcttttgcagtaagataaaaatattagtttaagttaaaaaggcaaccctttcggacatgatgttcttaatatttagatgagatttttgtgtttccgaaggatggctgatgcacagggaattcttttagtggctgctttttaaaactaatgttcaattcattaaagtgacaaattaaaaaccctagttttcccttaagcttttaagtttaacctaaaaataacattatcacagttataagtctactgatacttaacagtcatttccaagataactaattaatattttgacactcttctgaatattctgtcccatttacaaacatagctaaactgccttaaaataatttaaacttcatttataaatttaatataatagattctattactatatattttaaatatctgttcaacaagcaaaactttcccagatcctttgacattgcaagttaatgtattaaattatactttaaaaacataatataatctcaagttctttaaaatagcctaacattatttataaacagtcaaaatctcatacatttcaacttaaaattccaagtctaaactgaatgactcaactacatgttttatgtttcctcataaagctaatcttttagaattttaaaatgccaaattcttttaaatgtgacaatcatttgaaatgctggaaacccagattattcctaaacctaacataaatgatcagttcgatggctctgatttagttttttgtatatgtgctgttgtgggctgtcttgtatgtccagcctcaaccctcaaattcatatgttgacatccaaaccctcactatctcagtatatgaccttatctggagatgaggtctttacagaccttaagattaagttaaaatgagggaacagagagtgataccataagaaggtgggaagaatgcactttgaagaccatgttggccatttcacaagttggggagagcaggtgagctgagagctgataactgaaaggaagtcagtatgaagcagcaaaaagaacttagctcctcattgggaggagtaaaatgtgttaatagacaaacaccctagtgaagttaatgtattcatccattccacatgtaaaacacactcatttggaataagtgacgttatctagcagagtccactgttagcatattcataatccctgagtaactgagaaagacagtttttctgagcccctgtattggtttcttttttttttttgttttgcttccccactcccctaaagatcctgcctggaattgcctctcaaactacatgcactcaagtccttggtttgatattccaatctatgacagtaatgcacatttataaaattgtatctggagagagaaagctaatctggatattttgggggatggtggtaagggagcaatctcctattgttgtagtataaaaaaacagtgaatttggagtcggaaaacttgtattggaatcttaattctatcatgtattagatcagtgcacttgggaaatggacctctttgaatccccaaatcctagtttataaaatgaaggtaataaatgattatcaaatgaggtaatctatgccaaagtgtccagcacatagtaggtactcaggaaataggaatttcctttcttattgtttatatatttgtgttattgaaacatagttgaaaagataatgtgatgttgtagagagaaaaggttctatatcaaacaaacttacttttaacttcagtcctggcttcagaccatgatcctgggtccagtattcaatagaagaaatagtagctttcccctcttccagaactaagattattagaggcctttgtattaaagagatagagagattttactctaacagatgtccaaatgtgtatgatgtaatctgaattgtaatgtggaattaaaatatggcataccatgatcccatccatcaattcaaacacccttcttcaatttgatgttaaaagctttattactttatgattgtggaaaatttgtagacaatgtattagaacaaaaatccattgcaatgtgttagcacaaatctgaattttaggctcaataggccagtcttttgatagatttatcaagtgacttgtatctgaatggttaatcaggtgtattgataatgctggacaactcagagccatattgtatatgcaatattcacacacatatacacacacactagggtatttatttaacatgtatatgattgttagtttatgtcagtcactttagttccaagaatcaaagaacttggccctattagccagaacttaattgtcttggtcacttatccctgctgaagacagaatgattattaatcctgaattttataagggtccattcactgatattggcaatgtgttcctaattttaaaaatcattgattttactctattcaagcaaatgttaatttggatgtagaacttgaaggcttaactttgtcacactgatcattgggctttgcagggattaaaaactaaatgtgaaaattctctcagtgaagttgtgttgaattcaattttgagctattacctgtacatggaaaacatgaataatgaaataatagtaggtattttaaaaagaacacatattttatggcattatcctaaatactttatgcacaacataccaatatattctcataacctgcatatagagtaaggccatcccattttcagtgagaaaacagaggttacgggaagagaaattattatccatggccttgtgctaatagatgttagaatggggctttggaacagataccattgacttcaaaatttttgtactcactagtaccctataatgattcatgatcaaacaaaattttacctaaaattccaagagtctcacaacagccttccaatcttgtgcctgggcccaaggactctgggccaagaatctttttactagttgctgccactcatgcatgccccagcttctcggcttctccagagtttaatcccttcattaaaaaccaccattgttctcttttgttgacaaatttgagatgtcctttttgattttgacatgaagggaccctggataaggcctcatctcctttctagctccattcccttatgggctttgtctccacttcagaactacatgacttccaattcagtcaaacagagcttcttgctattctccctgtaccagcttctgagggctgcggtaacaaaggcccacagactgggcggcttaaacagcagaaatgtattgcctcacagttctggaggcggaagcctgaaatcaacatgacagccgggctggttcctcctgagggccatcagggaggaatctgttccaggtctctccttcaacttctagtgctttgctggcaatctttggtgttccttggttcctgctgcaccctacccccaatctctgcactcattttcacatggtattctccttccatgcttgtttttgttgaaatttccctgttttataaggacaccattcatactggattaggggctcaccttattccagtatgacttcatccggtcatcctaattacaccgtcaatgaccctatttcatttttttttttctttctttttttttttttgagacagagtctcgctctgttgcccaggctggagtatagtgtcgtgattttggctcaatgcaacctctgcctcctgggttcaagtgattatcctgcctcagcctctgagtagttgggattacaggcacctgccaccacccctggataatttttgtattttcaatagaaatggggtttgattatgttggccaggctggtcttgaattcctgacctcaagtgatcctcccacctcggcctcccaaagtggtgggattacaggcgtgagccagtgcacccagccccaatgaccctatttctaactaaggtcacattccatggcactggggctagagcctcaacatatgactttcaggcaaacacaattcaaactataacacctcctggtacaccaaacagttctgtgttttcagccccagaggaggctcttttaggctgttctttccctactactttagagtgaatttctagtcaacatttaaggctgtccccaaagtaaatgtttttgcgaagaaatctctaactcttgcaggttgttggttaccatttccaaacctgaaggaagctctttttgatttgatagccctccttacacgtgagggtataagttgtcatttcttttgaaacagtaagcccttcaagggcggtatccaggtctttttcacttctgtctctttagtgctatcacggtgtctggcacacagtgagtgaccagtaaaagttgtggagtgagtaaaccaaacattctccttactatattagggtccttctaactttctggtaaaggacaagtaaggggtggtcttcttgagactattaatcttacaaaatatgagacttcatgtttaaggatatgggtattgaaaacttttgcttggctaaataaaataaaagagctaagaggaaatttctggtgaaattgtctgatggcatttctcatgtccaatgtctaaaatttgccaagcttcagcttcatgcagtctctcccacttcctggctggtgtttagccattccagaggtcgaccagatgcttgcacagctgtcttgtgtgctcttgacactttccaaagttaggctacacatcaggaatgagaagctatgaactttcctggtaatttttccagggccggccatctcaaaatgtgtcttgcttgttggtatccacaggctcaaaccagttggaatttgaaggcaaatcccagctaactacttcattcgaggtggaaactgtaatgataaatgcgtgactccattaagcagagtctctgtggtggaaacacagtgatgaatgcaattctgagttctatcagtcctactgggatacaagttgtttagtagtcacaaatggcttagccataatgcagtcagcattcccaaagtaaagcatttccattcctgttactacaaaggataaattagctcctacaagggagggaatagaaatagctcctcaaacactgtctttaagaagttgcttaaaaccctcaccatgactgtctccatcacagacagctgtgttatttgttgattttaatactgatgatttgcattcacgtaataaggactcagaattactttacaaatagtctcattacaccttgcactgctgttgcaaagtaagtacatggttaattgtattttgttcatttttctaggcaggatcaggagccattgagtttaatttacctagagcatacactgatttaataatacacaagattgagaaaacaactgcaaagtaatgtggtttattttcttaacagacattctagaaattcaatatcacaatctagaatataaatgaaatgtccttatttaaatgttgctgacattgccagaatttagctttgggtagccttagtggtaaaagtacatgatttgtcctttggcattttagaaatggtcagacgacatccagaaccaagtctggtgaatacagtgtgtggccccactgcctgacagagattggtgatcagaaataaaacactgatttctattcaggtataccttctaatgtagctgttctgtaaattttcacattgcctgaaatgttttcaaatacagcagcattactggaaaaagtatatacagcctctcaagagatgtgtatgataagtcagcatttgaatatataggtttgggtatattttctcttaatagccccttggccaggcacagtggctcacacctttaatctcagcactttgggaggtcgaagtgggaggatcacttgaggtcaggaattcaagaccagccgggccaacatggtgaaaccccatcactactaaaaatacaaaaattagccatgtgtgggggcacgcacctgtaatcccagctactcgggaggctgggcaggagaatcacttgaacccaggaggcagaggttgcagtgagccaagatcacacaactacactccgcctgggtgatagagcaggactccatctgaaaaaaaaaataaaataaaaataaaaataaataaataaataaataacatagcccctcaaccccactcccacctcaattgccctaccaccatcaatgattgggtttcaattcttcctgtacccataaaaagggtttttgagtttgtatacccattttagagttccatgcgtgtgagaacacattacacctcctgtccaacttaaatattggcttcttacattacactccagttttggtatctgttgtagactcagaccctgactaaggaatggatcagcccagaagatgtctaggatgctaatctttgtggagcgccaaacgttacaagtgtgaccaaatctttctgaaaaggaaaggagactgagaaaattgtaactgctcaaattcctcttcttactctactaataaaagccaatgcttatatgtagtccagtctgtagcaggcattgttagaagtgaataaactttattaacttctttaaatctcacaacttaatgatgtagatatgattattattctcattttacagatgaggaaactgaggcagagagaggttaaaaagtagcacggctaggaagtgccatatctcatatgatgaatactaaagttactatggaaaatacttcaaaaatctctttaagaaatgcccgaaaccactgccccaccaggttatatttgagaattgtaacatgttcatttcatttagctcctcactaaggaggataagcccagagggcagctggggtttttgcttggctgaaggtatgtacattctgtggccagaactgattgttcagggcaaggaaaagagtaagcccagctgcctgctgccaggcccttctctgtccttcccccaggcagctctcaatttcttctccaagtcaatgtgaacaaatgacccaagtatgcacgctggaaagggtagcagtgtattagtctgcttggggtgttaaattattagcctgcatgaaaagcctatatatctttgtcagaagctgctcaggttgaatgtattttcatgaaaataggccctgaaataattcaaaaaaggaaaggagaggtaaaacagcagaaagttcagagcacaagtgatacaggcactagcattacgtcctgatgataggatgggacttgtctctctaagccacgagaactcccactaaaagactgtggaatgggctttgttggcttgtttttgtcctgtgggagagaagctcggctgtggttgtactgccttatgacactggggtgtttgctgaattggtggaacctttttcctcctcaggaaaatctaagttcttcacatcaagattctcaaagaattttacatacatgcagctgaactaggccatcattaggccagaaacataaaaatggagttttatgttaggaagagattgccatgcctgcattaaggaacttgactcaggccaacaaaaatatgctacataaaaagtttatcagcagtctgggcacagtggctcatgcttgttatcccagcactttgggaagctgaaatgggcggaatgcttgaggtcaccaaatttttatggatgcaccataaaaaatgtgtcataattacattatcttcccttcctaatatccacactatccccgtggacccactctgccagcaactactgtttcttcaaatttgtcttgctttttgcataaagaactgttttcttaaagtcctgtttctgtttaagaaactctcatgaatccagatgacgccgaaatataaaccccaatggtatgtatttccaagcttccaacaaatatattgctctgtattctcaactagcttaactttgatccctaactaaaaaatgtttgctggtcccatcaacatatgcatttatgagatcaccaataagatagtatgatttcagggggtctaggaaaggtggtaatccccatatatttctctcattcacttggatgtagcctgctatttcattattagcatttctttcatttgcttaagattttgatcttgtgaagggtgctccctcctaagacataagcatttcaaacttacacttcagtgtgaaggacttttctgaaggcaaataagataggtcaatattcacagaatatgagggtacttgaagtaaaagaagaagctgtcactacatacaggatatttcatgtgtgtgtgtgtgtatgtgtatgtgtgtgtcatcagagatctgaaatacacaaacatggttatcatcttacacaaaaatccaaagatgtttcatttcagtaaattgatttatgttaactaaggatccaggaggcagtctataattcatgttgcacttctagttaagtttagagggaggaatatttggctagagaactgtgatctgttatctgcatggatccagaaatcagacatccaaattttcaagaaccacactacatttcaagccttctgtcacatattcaccccaatacactcatatctgtagaactatatgtccagattgttgatctagactatctgaaaaatgccaatcctactcttaggccaacccttttaggtaggttatctattcagaaagacataccgttttcaaagtttcgcctattggttctggagtcagaaataaactttctctatgagaatatggttcaacagacccatcatcttttccttttttgcattatctcctagagaagaattctacgaattttgcaccatgctagtttcctaaaatccagttcctttttccttgatctttatttaaggtcatgatccagaaaaccttaagaatcatttcgatcatctgatctcttcttcttaattccttgttaatttcactctacctataatttacagtgggtataacatttcacattcacaaatgtacatgtgcaaaaatgtgtttttgcaaaactaaacttaatgtagctttacaaccttatagtatctgtttccacaagatagccaaaaacttataccaattcaaagttattcactcacttccaattaagaactttgtatctttgtgtgccaccagatcaatccaggagtttctctactttgctatccttctccatagaagttaaataagtttccaggtggctgaaatattgtgacttattgtcctgggataaggtgagggctatctggccttcctgttacatcatgtcctctttgaccgttgctaagatgtggcttgtaacacttgatcgtgcacatccatttctggccctgctacatctgctgtggttatctgagacccaagctcagaccccagacaacacttgacatcatgtaagcccaacaagcaaagccagttagccccttctgtgctcttccttcagggctgacgaattcttgccggccttttccaggctacactgaggtgctcacattgatgccctgcctttcaagtatccacttcagctttggttggacttggagcacttctaagaggcctgcagtctcctaaactatcctctgataggccaggtcttctcttctaagacctaaggtttctgacagtgtttacataatccatcctgaacaacagattcattctaagataccaagcagttactcctggcccctgattcttccttcctactctctggatgcacctttgtctcttgggggtgggaacctgctctgggatcattactcaagatatcccccctctacaagtcatgccatagacattctaatatgagccctccatcgttgtcaggatttggagtttaataaaactttttttttttttttttttgtgagacagagtctcactgtgttgcccaggctggaatgtagtggcgccatctcactgcaagctctgcctcccgggttcacaccattctcctgcctcagcctcccgagtagctgggactacaggtgcccaccaccatgcccagctaattttttgtatttttagtagagatggagtttcaccatgttagccaggctggtttcgatgtcctgaccttgtgatttgcccgcctcggcctcccaaaaaacttttttctgtaagaaattccagctcatactgtagcaggacttgcacttatggctcgtatttctgctattttcagcaatgtctgatttgatgttggaaatttagtaataatttatttctttctggcagtttctggtcacccctggggacagtacttatggaagatagttttggttttcttagggacttccagtaagctgaaacttccctctattccttcatattttatttaaagcttgtttccataaaagtcatcacaaaataaaccactttatcatctttgttttttttttctttttgtacaggcattgcttgctacatttattaacttgtcaaggttacttaatctaagggttgtgtccctgtgaaagacaaaatgcacttggtaattaaagagattattttattcagtcaaaccattcattaatgaagagcaagaacacctggggtttagaaaggcaggtaaacaagagggccatgaagaaggataggcagggagacttagaggtttggagaagagtgtggagggcattcttattgtggaatataccaggcagggtgattcttggtggttagccgtttcccagaacaccagtaaaggattaaagttcaacatcgtcagttctcctttttgttcaagaagaatattattctttgttctgtaatctgatgattacttagaaggttaaaaaaaaagccaacaaaaaaaaaaccctttacaaacttttactaaagcagacaaggtaaacacaagctctttttaaaaatcctgtaaataaacccatcaaaccttaactaactttgaccatggtaaataaatttcccctttgtttttttggagaactttgtacatctattcaggttttgtcttgcacaacaacagtcagtcatttcaccttaggacaaaaccattcttttcagcagacaagctgagctcatgaattatacaactcacaactttctgcagccacccattccttatagtacaactttacgaagtggtaaaaatcagcatgttcattaacaggcccaagtatataatctccaagtaacagaaaataagaggcaaaatatagataaacttaagactttgctttgtttcagtactctgtcttactaggaaatgatttaggtattcaataaatatctatcaattaactaactttagtgtaaatctgaggttttaagtggcctaaagatcttggaaattatcttcaagctgacatactataaaacaaaattactattgaaataaggttggtcatgataataatttatttggttaaacacaaatttatactttccataattttaaacattaatcttaaacattagtaatacaagcttaataaatcagtaaacttgtatacatttacacagaacattcccaaatagaaataaaaatctatgtatatattatgcttaaccctgataaatcagagaagacatagctgtttttattaaaaccaaaaatattaaactagtcttgtttgccaaagctttatctaaattatgtgaacttgaattcctaaatcatatccaagttagtttctgtaaaaataatttttaaatcaagacattgaaagtatttgagattcagttttcacttattttttattttttaatttttttcctttttgtggagaacgggatcacactatattgcccaggcaggtctccaactcctgagctcaagctatcgtctcacctcggcctccctaagagctgggattacaggcgtgagccaccgcgcccagctagattcaattttcttaatttctggaaatattaggaatattcaatttatataagtatttacttatctctgaaataacaagaatagagcaccattaagagattttataatctaatgactaatatcatcctgtggtagagaaatgttacacattcacacatgacaggtaaaggcctctctgaattataaatacataaacctgcaggcatagagagagcttacagtttcaattctgaaattttagccatgggtcaagtataaatacataattacaaaactcattggttca

SEQ ID NO: 2 - protein, 192 aa, Homo sapiens
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGIC

SEQ ID NO: 3 - protein, 422 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 4 - protein, 204 aa, Homo sapiens
GRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEAEELYQKRVLTITGIC

SEQ ID NO: 5 - protein, 163 aa, Homo sapiens
GRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECF

SEQ ID NO: 6 - protein, 85 aa, Homo sapiens
FYQLGLHLLSLEHIQSFFLFFFLRRSLALSPRLECSGRISTHCKLRLPDSRHSPASDPGVAGTTGACAISMNRAAIRTKTVLRSS

SEQ ID NO: 7 - protein, 47 aa, Homo sapiens
MWCEMFYGQKMEMRCRNWRLRINLKTKSRFWPDTDAKVTPMLSLLLR

SEQ ID NO: 8 - protein, 19 aa, Homo sapiens
MWCEMFYGQKMEMRCRNWR

SEQ ID NO: 9 - protein, 65 aa, Homo sapiens
YGQKMEMRCRNWRLRINLKTKSRFWPDTDAKVTPMLSLLLRYKLPYFKQLFHLFNSIPFLSLFHM

SEQ ID NO: 10 - protein, 141 aa, Homo sapiens
MKKRNEMIFLATLKNKALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVN

SEQ ID NO: 11 - protein, 193 aa, Homo sapiens
MKKRNEMIFLATLKNKALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLC

SEQ ID NO: 12 - protein, 146 aa, Homo sapiens
MKKRNEMIFLATLKNKALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLV

SEQ ID NO: 13 - protein, 645 aa, Homo sapiens [sequence omitted]

SEQ ID NO: 14 - protein, 637 aa, Homo sapiens [sequence omitted]

SEQ ID NO: 15 - protein, 211 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCK

SEQ ID NO: 16 - protein, 640 aa, Homo sapiens [sequence omitted]

SEQ ID NO: 17 - protein, 462 aa, Homo sapiens [sequence omitted]

SEQ ID NO: 18 - protein, 241 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 19 - protein, 156 aa, Homo sapiens
RGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECF

SEQ ID NO: 20 - protein, 171 aa, Homo sapiens
KGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECF

SEQ ID NO: 21 - protein, 198 aa, Homo sapiens
MFLFERLPGDQSCFSFSFLLLALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLC

SEQ ID NO: 22 - protein, 164 aa, Homo sapiens
MFLFERLPGDQSCFSFSFLLLALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLC

SEQ ID NO: 23 - protein, 122 aa, Homo sapiens
MKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECF

SEQ ID NO: 24 - protein, 175 aa, Homo sapiens
GSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECFMVKDLSNPSRYLCKCPNEFTGDRCQNYVMASFYSTSTPFLSLPE

SEQ ID NO: 25 - protein, 128 aa, Homo sapiens
GSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCK

SEQ ID NO: 26 - protein, 192 aa, Homo sapiens
GSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 27 - protein, 157 aa, Homo sapiens
SKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 28 - protein, 254 aa, Homo sapiens
RCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNTMNIANGPHHPNPPPE

SEQ ID NO: 29 - protein, 552 aa, Homo sapiens
KSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNTMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 30 - protein, 125 aa, Homo sapiens
ASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESAQMSLLVIAAKTT

SEQ ID NO: 31 - protein, 296 aa, Homo sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYSTSTPFLSLPE

SEQ ID NO: 32 - protein, 196 aa, Homo sapiens
GGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYKHLGIEFMEAEELYQKRVLTITGIC

SEQ ID NO: 33 - protein, 129 aa, Homo sapiens
PKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYKAEELYQKRVLTITGIC

SEQ ID NO: 34 - protein, 119 aa, Homo sapiens
RTPKSATQPQTTETNLQTAPKLSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKT

SEQ ID NO: 35 - protein, 101 aa, Homo sapiens
DFKEQESMQIPKHISIEDITATSTSTTGTSHLVKCAEKEKTFCVNGGECFMVKDLSNPSRYLCKCQPGFTGARCTENVPMKVQNQEKAEELYQKRVLTITG

SEQ ID NO: 36 - protein, 101 aa, Homo sapiens
MQIPKHISIEDITATSTSTTGTSHLVKCAEKEKTFCVNGGECFMVKDLSNPSRYLCKCPNEFTGDRCQNYVMASFYKHLGIEFMEAEELYQKRVLTITGIC

SEQ ID NO: 37 - protein, 27 aa, Homo sapiens
MQIPKHISIEDITGAQMSLLVIAAKTT

SEQ ID NO: 38 - protein, 350 aa, Homo sapiens
GECFMVKDLSNPSRYLCKCQPGFTGARCTENVPMKVQNQEKHLGIEFMEAEELYQKRVLTITGICIALLVVGIMCVVAYCKTKKQRKKLHDRLRQSLRSERNNTMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQ

SEQ ID NO: 39 - protein, 165 aa, Homo sapiens
MCVVAYCKTKKQRKKLHDRLRQSLRSERNNTMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSER

SEQ ID NO: 40 - DNA, 24 bp, Homo sapiens
cagttctggaaacttttctgtgtg

SEQ ID NO: 41 - DNA, 25 bp, Homo sapiens
cagatccacaagttctacaatagca

SEQ ID NO: 42 - DNA, 26 bp, Homo sapiens
ttttctttactggtgctctctagtgt

SEQ ID NO: 43 - DNA, 20 bp, Homo sapiens
tgcaggcatagaattctcca

SEQ ID NO: 44 - DNA, 26 bp, Homo sapiens
gagtagttgggactacagatgcacac

SEQ ID NO: 45 - DNA, 21 bp, Homo sapiens
cagcttgggcaacaaagtaag

SEQ ID NO: 46 - DNA, 20 bp, Homo sapiens
ctcaaattttgggggctcac

SEQ ID NO: 47 - DNA, 26 bp, Homo sapiens
caatattatacaatttctggcagcat

SEQ ID NO: 48 - DNA, 20 bp, Homo sapiens
atactgaagggcaggggttt

SEQ ID NO: 49 - DNA, 23 bp, Homo sapiens
attttctgggtgatttcctcatt

SEQ ID NO: 50 - DNA, 20 bp, Homo sapiens
aggcttctggaccctcaaat

SEQ ID NO: 51 - DNA, 20 bp, Homo sapiens
ctcagctttgccctctgaat

SEQ ID NO: 52 - DNA, 20 bp, Homo sapiens
agggcaggaacctttcatct

SEQ ID NO: 53 - DNA, 20 bp, Homo sapiens
tagcgagaaagttggggaga

SEQ ID NO: 54 - DNA, 20 bp, Homo sapiens
agtgagtagggctggctgct

SEQ ID NO: 55 - DNA, 20 bp, Homo sapiens
gctgctaatatggccccttc

SEQ ID NO: 56 - DNA, 21 bp, Homo sapiens
ccacatgtccaactgaagagg

SEQ ID NO: 57 - DNA, 27 bp, Homo sapiens
tctccatgtgtaaaacaatacatatca

SEQ ID NO: 58 - DNA, 27 bp, Homo sapiens
cttttaatcatgaaagaatagcaaaaa

SEQ ID NO: 59 - DNA, 27 bp, Homo sapiens
tgttgttgtatatttcagaatttcctt

SEQ ID NO: 60 - DNA, 19 bp, Homo sapiens
ggcatgtcccaatttggtt

SEQ ID NO: 61 - DNA, 20 bp, Homo sapiens
tgtcccagctgatctaagca

SEQ ID NO: 62 - DNA, 23 bp, Homo sapiens
gagttttgaggatcctagagcaa

SEQ ID NO: 63 - DNA, 24 bp, Homo sapiens
gaagggctaaaaggagaattcata

SEQ ID NO: 64 - DNA, 23 bp, Homo sapiens
tttgcttatggtgtcattctttc

SEQ ID NO: 65 - DNA, 22 bp, Homo sapiens
ggagttcctgggttctaatctc

SEQ ID NO: 66 - DNA, 20 bp, Homo sapiens
ccacagcatgcaaaatgaac

SEQ ID NO: 67 - DNA, 20 bp, Homo sapiens
tgtaggatgccaaggaggtt

SEQ ID NO: 68 - DNA, 20 bp, Homo sapiens
ggcagcaatacaaacacagc

SEQ ID NO: 69 - DNA, 20 bp, Homo sapiens
ctagggtcaatgggtgagga

SEQ ID NO: 70 - DNA, 20 bp, Homo sapiens
tttgggatgtttcagccatt

SEQ ID NO: 71 - DNA, 20 bp, Homo sapiens
tggaaggctccatgaaagtg

SEQ ID NO: 72 - DNA, 20 bp, Homo sapiens
agaagcaaggatccccagtt

SEQ ID NO: 73 - DNA, 24 bp, Homo sapiens
gcaaacataaagtatgaccccttg

SEQ ID NO: 74 - DNA, 20 bp, Homo sapiens
acattgcctccaaccaagtc

SEQ ID NO: 75 - DNA, 20 bp, Homo sapiens
caggtatgagccacctctcc

SEQ ID NO: 76 - DNA, 20 bp, Homo sapiens
tgcagcagtagtgaccctgt

SEQ ID NO: 77 - DNA, 21 bp, Homo sapiens
atcaccctgacactgaggaga

SEQ ID NO: 78 - DNA, 20 bp, Homo sapiens
ggcctggaaaaagtgtgtgt

SEQ ID NO: 79 - DNA, 20 bp, Homo sapiens
gcccgtgaatctcttgtgtt

SEQ ID NO: 80 - DNA, 20 bp, Homo sapiens
gcaacttcatgcctgtagca

SEQ ID NO: 81 - DNA, 20 bp, Homo sapiens
caccctgtgaaaatggctct

SEQ ID NO: 82 - DNA, 20 bp, Homo sapiens
ggttcttcgaaatggcaagt

SEQ ID NO: 83 - DNA, 19 bp, Homo sapiens
ggcgagcagagtgagacac

SEQ ID NO: 84 - DNA, 21 bp, Homo sapiens
tctgtgacgcaattcaatgat

SEQ ID NO: 85 - DNA, 21 bp, Homo sapiens
accagcctggctttaaaacat

SEQ ID NO: 86 - DNA, 20 bp, Homo sapiens
gcaaagcttctccacactcc

SEQ ID NO: 87 - DNA, 20 bp, Homo sapiens
aacctggaggttcaagtgga

SEQ ID NO: 88 - DNA, 20 bp, Homo sapiens
tgtcactatggcccactgaa

SEQ ID NO: 89 - DNA, 20 bp, Homo sapiens
gaaaagcatggcagatttga

SEQ ID NO: 90 - DNA, 20 bp, Homo sapiens
cccagaaagcaggcaagtag

SEQ ID NO: 91 - DNA, 20 bp, Homo sapiens
catgaaaaagacgcaagcaa

SEQ ID NO: 92 - DNA, 20 bp, Homo sapiens
cccttagaagaggccaggtt

SEQ ID NO: 93 - DNA, 18 bp, Homo sapiens
aggttgcgctctcctgct

SEQ ID NO: 94 - DNA, 20 bp, Homo sapiens
ttagccaagcacagtggtgt

SEQ ID NO: 95 - DNA, 19 bp, Homo sapiens
ttggttccctgacccctaa

SEQ ID NO: 96 - DNA, 20 bp, Homo sapiens
acaggaagactgccatttgc

SEQ ID NO: 97 - DNA, 21 bp, Homo sapiens
aagcctttgctcatgttctca

SEQ ID NO: 98 - DNA, 20 bp, Homo sapiens
aaatttcatgatgcggaagg

SEQ ID NO: 99 - DNA, 20 bp, Homo sapiens
acgctttttgaccacacaca

SEQ ID NO: 100 - DNA, 20 bp, Homo sapiens
cccatggaactaccacacaa

SEQ ID NO: 101 - DNA, 20 bp, Homo sapiens
agggcctttccttcaaaatg

SEQ ID NO: 102 - DNA, 20 bp, Homo sapiens
aagcagcaggcaaaatgagt

SEQ ID NO: 103 - DNA, 20 bp, Homo sapiens
gatgcaaaggcaagtccagt

SEQ ID NO: 104 - DNA, 1006 bp, Homo sapiens
cggtttttttgccttttctattttgccttttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgrgggcctcggtgtgctactygtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcg

SEQ ID NO: 105 - DNA, 592 bp, Homo sapiens
gcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggygggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccmtcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccag

SEQ ID NO: 106 - DNA, 178 bp, Homo sapiens
ccttgcctccccrattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagg

SEQ ID NO: 107 - DNA, 51 bp, Homo sapiens
agatcatcactggyatgccagcctcaactgaaggagcatatgtgtcttcag

SEQ ID NO: 108 - DNA, 1160 bp, Homo sapiens
gcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctstgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaacttt

SEQ ID NO: 109 - DNA, 675 bp, Homo sapiens
ctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccrgtgatcacctgccaaatgaataagacaacaaagagaagcagaagggcagaagattatttactgacatatatctattacacttgggattgtctyactgttgcataactattttttaaacggagtttagttttatattgctagtaaaaaaa

SEQ ID NO: 110 - DNA, 103 bp, Homo sapiens
aggcggaggagctgtaccagaagagagtgctgaccataaccggcatctgcatcgccctccttgtggtcggcatcatgtgtktggtggcctactgcaaaaccaa

SEQ ID NO: 111 - DNA, 127 bp, Homo sapiens
gaaacagcggaaaaagctgcatgaccgtcttcggcagagccttcggtctgaacgaaacaataygatgaacattgccaatgggcctcaccatcctaacccaccccccgagaatgtccagctggtgaat

SEQ ID NO: 112 - DNA, 846 bp, Homo sapiens
gtatgtgtcagccatgaccaccccggctcgtatgtcacctgtagatttccacacgccaagctcccccaaatcgcccccttcggaaatgtctccaccygtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagcyrgcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttc

SEQ ID NO: 113 - DNA, 558 bp, Homo sapiens
aatcgggcagccattagaaccaaaacagttctgaggagctcccaggctgcaatgtggtgcgaaatgttttatggacagaaaatggaaatgaggtgcagaaattggaggtgagattcagagatagctgattggttacagctcagcctttgccttgtttgaacatggtttgaacagttgattgactgaagctaggctgctgtgattggctgatactttactatttgttacaaaggcaaattcctaatttaagctttcaaattgtttaartactaagttaggttttactttgttacttaggactcatatcgaggtttctaaagcccacatctgatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaaagccacaaattttaaaattctgatataatctaatatctggtattcagctttgtattatcattttaaaatttaatgaacat

SEQ ID NO: 114 - DNA, 178 bp, Homo sapiens
gctaagaataaacttgaagacaaagagtagattttggccagacactgatgctaaagtcaccccgatgctgtctttgcttctaaggtataaattaccttattttwagcaactttttcaccttttcaactctatccctttcctcagcctctttcatatgtgaaataaaatattcacttac

SEQ ID NO: 115 - DNA, 262 bp, Homo sapiens
atgaaatttcagtctttattcaagrtcaagtgcaactgtctctttgaggaaagtcctttgaccgccatttctccccttcagaaggcaaacacctgggggagaagatctgcttaaggacctggtaactgacaaagaatggaatgggagcgagaaccgcctagccatcccttctccttgcacagtcatgaaacaaaagttgaaaaggagcctggttttacttgaccagtcataaattaccataaaataaaatgagatattagga

SEQ ID NO: 116 - DNA, 260 bp, Homo sapiens
caagcactttataccactttttataaaataagccctcactttcattacattatttaactygtatttctgccttgtgttatagatagaaagtatattattatttctactttatagctgaagaaactgagtccaaaatgggtagagcaactggcactaaagatcacctagccagtccgagwtcacacagtcagtattaggactggggccttgtgccttccagtgcagggtcccttacaccagtcatgacatagatgcccaga

SEQ ID NO: 117 - DNA, 379 bp, Homo sapiens
caagcactttataccactttttataaaataagccctcactttcattacattatttaactygtatttctgccttgtgttatagatagaaagtatattattatttctactttatagctgaagaaactgagtccaaaatgggtagagcaactggcactaaagatcacctagccagtccgagwtcacacagtcagtattaggactggggccttgtgccttccagtgcagggtcccttacaccagtcatgacatagatgcccagatcatgcatgacttgatgtaaaaacaacaatttttgttgtcccagtttgagtccttataaatttcccctgtcaaagaaataaacatgcaactctcagaaattatcttttatggagctttt

SEQ ID NO: 118 - DNA, 401 bp, Homo sapiens
ggactggggccttgtgccttccagtgcagggtcccttacaccagtcatgacatagatgcccagatcatgcatgacttgatgtaaaaacaacaatttttgttgtcccagtttgagtccttataaatttcccctgtcaaagaaataaacatgcaactctcagaaattatcttttatggagcttttaaaggccactttgccaargggagctatatarccatgacataaacatgaagatggattgacagaaaatactctttcacaggctggaggaaatattgggggaaagaaattttctcagactgcccttccaacgtggcatggatcatggaggtcagcttttctagcttgtgcccagaggtctgtctacctcagctgtgtcttgtgattgataggaggataca

SEQ ID NO: 119 - DNA, 401 bp, Homo sapiens
gtgccttccagtgcagggtcccttacaccagtcatgacatagatgcccagatcatgcatgacttgatgtaaaaacaacaatttttgttgtcccagtttgagtccttataaatttcccctgtcaaagaaataaacatgcaactctcagaaattatcttttatggagcttttaaaggccactttgccaargggagctatatarccatgacataaacatgaagatggattgacagaaaatactctttcacaggctggaggaaatattgggggaaagaaattttctcagactgcccttccaacgtggcatggatcatggaggtcagcttttctagcttgtgcccagaggtctgtctacctcagctgtgtcttgtgattgataggaggatacagtctcccagggtg

SEQ ID NO: 120 - DNA, 401 bp, Homo sapiens
tcacaggctggaggaaatattgggggaaagaaattttctcagactgcccttccaacgtggcatggatcatggaggtcagcttttctagcttgtgcccagaggtctgtctacctcagctgtgtcttgtgattgataggaggatacagtctcccagggtgtgatttaaggtggagcttataggtctacaaagctcaagctctwatcaagctactatggcatgatagtacaattataaagaaagtagactagtttctataagctgtgtataaaaccaggcccaccctaacatttgcagggcctaggccaagagtgtatgtagagtctcatataccgtatgtctaaatatttcaaagttataaaccaagaagggcctgtggcccaaactgtgttcccaccctaag

SEQ ID NO: 121 - DNA, 401 bp, Homo sapiens
gtggggccctctaaagcagagggtcctggaggagtctcttcagtccaatggctgaattactccaagactctttcatacaaaagttagctgggcatggtggcatgcgcctgtagtcccagctacttgggagactgaggcgggagaatcacttgaacctgggaggcggaggttgcagtgagccaagattgtgtcattgccctytagcctgggtgacagagcaagactccatctcaaaaaacaaaacaaaacaaaacaaaaaaaactctttctttactttataaccatatggcaggacatctcagttcatctatgacctgtggttttaaagtaaattctgtttaaagttatctttaaaatagctttatttttgttaaaatagagccatatcttcatctgcggga

SEQ ID NO: 122 - DNA, 401 bp, Homo sapiens
ggcaggacatctcagttcatctatgacctgtggttttaaagtaaattctgtttaaagttatctttaaaatagctttatttttgttaaaatagagccatatcttcatctgcgggaaatcatattgactccatgataagctatattctggaaaatagtcagtgtgctgacgattgctacctgtgagtagctcacccaacccayaggcaaagtagcaaagagagaggcatggcaacccccaacgtgagaggcttgtagacaacccacagttctagcagatgtcagtgcaacggggcaaatttcatccccctcagagcatggctctgggcaccactggacacatctgtttcaggataatttgaagtccagttgttcagacagagttgatcttaagaccatggtgg

SEQ ID NO: 123 - DNA, 401 bp, Homo sapiens
agtcaactcaggctgccataacagaataccacagaccaggtggtttaaacagcagatatttacctttcacagctctggaaactgggaagtctgggattaagctgccagcatggtcaggttctggtgaggggtcacctcttggcttgcaggtgtccaccttcttgccgtgtgctgtgtgtggtggagagatctctccttacragggccctgattccatcatgagcccatctaaccatgattacctcccagaagccccacctccaaataccatcccattgggggttagggtttcaacatatgaattttgagaggacacagacattcagtccataacaccaaatctgtattcatcctagttcagcacagagcagaacctatgtttacccaatatcctttgaata

SEQ ID NO: 124 - DNA, 401 bp, Homo sapiens
gccaaaaattatagcattcaaaaaatgtgccacaaaaacaacaaagttgacaactactgatctggaacctttctaaatgtgaccagtcagagaccatagccaatattttctattgtctatagaatgggatgggcagagaaaacagctaacaaaaaaggaaaaaacaacccaaaatatttcatggtttcagctttattagcmtaacagtcaagttgttytggttccacgacttttaaattaagcgaaggagaactctcccatcaataggttcattgtgatgccaaactttacatattttggaaaaacattcatttacccgccaggcaagctgcctsctctcttagagttcgtggtagggaactataagcataaagacctttctgaggaggttttccttattt

SEQ ID NO: 125 - DNA, 401 bp, Homo sapiens
tcaaaaaatgtgccacaaaaacaacaaagttgacaactactgatctggaacctttctaaatgtgaccagtcagagaccatagccaatattttctattgtctatagaatgggatgggcagagaaaacagctaacaaaaaaggaaaaaacaacccaaaatatttcatggtttcagctttattagcmtaacagtcaagttgttytggttccacgacttttaaattaagcgaaggagaactctcccatcaataggttcattgtgatgccaaactttacatattttggaaaaacattcatttacccgccaggcaagctgcctsctctcttagagttcgtggtagggaactataagcataaagacctttctgaggaggttttccttattttattgactgcctcatat

SEQ ID NO: 126 - DNA, 401 bp, Homo sapiens
agagaaaacagctaacaaaaaaggaaaaaacaacccaaaatatttcatggtttcagctttattagcmtaacagtcaagttgttytggttccacgacttttaaattaagcgaaggagaactctcccatcaataggttcattgtgatgccaaactttacatattttggaaaaacattcatttacccgccaggcaagctgcctsctctcttagagttcgtggtagggaactataagcataaagacctttctgaggaggttttccttattttattgactgcctcatatatttacaacttcccaatttattttttcagactgctaactcctgtgttcctagattcccatttttcaattgattgtgggctttttctagggttacagatttaacttccatgcaagtgg

SEQ ID NO: 127 - DNA, 401 bp, Homo sapiens
aaacaggttgcctatagccttacaagtggcctccttggtttttagtggcatagtgcaggtgagccatatattatgcttctcaatttatttccattggtcagaaaactggtaaaaaattccttttcaatggtatagttttcgaatctcaacagagacttctttggtcttagtgatgagtcttcatggtattttggcttgcaygtagtaacaataatcaagtcattcacccagtgcaagattttggtgtctttatttttaactatttgtattgtgcattatcacatagataaccatttgttttgctggtctcattgctcacgtagaagtctgaatataattctttctcagagtgtgggaaatcatggattgatattcttagtttttgatgtagtgctttttat

SEQ ID NO: 128 - DNA, 401 bp, Homo sapiens
gaagtcaggaactgtgagccacctgccatcttaatttgacatctagtctcactactttcaagcacctccacttcaaaatactcttacaagtgaatcaccattgttaaatggatctttgaaggaattttgacaaccagactgaaaacaatctagacatcttagatatttgtggcttcacagaaaataaaataaaacaacccwtttcagcatcaagttatattttccatagctacagaatctggtaaataactatgttactcattcatctaggtagtttgatactacctactgatactggagttggggagggaagtgctgggaagggaagggtgtggtccctggctagggctccacccctgggcctgtgcccatgaacctaggtgaggacaggcatttctgtt

SEQ ID NO: 129 - DNA, 401 bp, Homo sapiens
cccactccatctcccttctggctcccccatctgctgagagctacttccgctcgctaaaatctttgcactcattctccaagcccatgtgtgatctgattctgctggtataccaaggcaagaaccctgggatacagaaagccctctgtccttgcgataaggcaaagggtctaattgagctgactaatgcaagccgcctacagrgagctaaactgaaagagcacactgtaacacatgcccactggggcttcaggagctgtaaacattcrcccctagacactgctgtggggttggagccccacagcctgcccgtctgcatgctcccccttgaggtttgagcagcggggcaccagagaagtgagccactctccctgtggcacaccctgtgaggggsacaagggaac

SEQ ID NO: 130 - DNA, 401 bp, Homo sapiens
cactcattctccaagcccatgtgtgatctgattctgctggtataccaaggcaagaaccctgggatacagaaagccctctgtccttgcgataaggcaaagggtctaattgagctgactaatgcaagccgcctacagrgagctaaactgaaagagcacactgtaacacatgcccactggggcttcaggagctgtaaacattcrcccctagacactgctgtggggttggagccccacagcctgcccgtctgcatgctcccccttgaggtttgagcagcggggcaccagagaagtgagccactctccctgtggcacaccctgtgaggggsacaagggaacttttcccattttactaccaaggccagtgacatgaatgatcaaatacyaaccagctacattttatt

SEQ ID NO: 131 - DNA, 401 bp, Homo sapiens
ccgcctacagrgagctaaactgaaagagcacactgtaacacatgcccactggggcttcaggagctgtaaacattcrcccctagacactgctgtggggttggagccccacagcctgcccgtctgcatgctcccccttgaggtttgagcagcggggcaccagagaagtgagccactctccctgtggcacaccctgtgaggggsacaagggaacttttcccattttactaccaaggccagtgacatgaatgatcaaatacyaaccagctacattttatttaatttttaatttttttagttgtcagaagattttattaactgtaagccagggaatggactgatcgattttattatgcaaatcaatgaaaaaaaaaaactcttttagaaggacacaaacacacaca

SEQ ID NO: 132 - DNA, 401 bp, Homo sapiens
caggagctgtaaacattcrcccctagacactgctgtggggttggagccccacagcctgcccgtctgcatgctcccccttgaggtttgagcagcggggcaccagagaagtgagccactctccctgtggcacaccctgtgaggggsacaagggaacttttcccattttactaccaaggccagtgacatgaatgatcaaatacyaaccagctacattttatttaatttttaatttttttagttgtcagaagattttattaactgtaagccagggaatggactgatcgattttattatgcaaatcaatgaaaaaaaaaaactcttttagaaggacacaaacacacacacgtgctcacagggaagctggttgttggttgagagtcaggtcagaaccttggagagct

SEQ ID NO: 133 - DNA, 401 bp, Homo sapiens
gctctcaaccagctacattttaaaccctattttctctaaagatacatcaacagattagcttattcttcagtcctggatctaacataatttgtacagtaaagtgaagataaagtttattcagattatttgtacaagtactttctcatcaaagtgcagcagtctactttctgtttcccatgggtgataggagatagggttaaygaaacagcagtaatttagagaccagttttagctgcatattgcartctttctttagaactatcctaaaagctgtctgttgctttgaaatgaatcttacttccatttcctccttttcttttggacctgctcaggagcaataaaatagagcaaatgtaaacagcagaaatgagacagaaggggacttggagataaaagaaatt

SEQ ID NO: 134 - DNA, 401 bp, Homo sapiens
catcaacagattagcttattcttcagtcctggatctaacataatttgtacagtaaagtgaagataaagtttattcagattatttgtacaagtactttctcatcaaagtgcagcagtctactttctgtttcccatgggtgataggagatagggttaaygaaacagcagtaatttagagaccagttttagctgcatattgcartctttctttagaactatcctaaaagctgtctgttgctttgaaatgaatcttacttccatttcctccttttcttttggacctgctcaggagcaataaaatagagcaaatgtaaacagcagaaatgagacagaaggggacttggagataaaagaaatttgtttcttctgcattcttcagaatgcagagtagttcctggcaga

SEQ ID NO: 135 - DNA, 401 bp, Homo sapiens
aggctctgctttctaagaaatcaggagtaaggtactgactaccccagagctgtctcacttggagctctttccctcaagcttttctgtttagtgtttttgtttgccatccaaggacataaaaagagaaggatccttcctcaaaaaccatgccctcagtctcctatgttactcctttttttggtgctgtgtaatagttatttyacaccataataaatattagctatacttgccattgtataggtgtaggggaggatgaggaggttcaaactgtattcccaacatcataacttcctgttacatccaagagctgttgaacaatatcgagtttcccaacrtatgtgtgattggaatcaaaggaggagaagaaagggagacagttcagaagataatatctgtggaaa

SEQ ID NO: 136 - DNA, 401 bp, Homo sapiens
tcctcaaaaaccatgccctcagtctcctatgttactcctttttttggtgctgtgtaatagttatttyacaccataataaatattagctatacttgccattgtataggtgtaggggaggatgaggaggttcaaactgtattcccaacatcataacttcctgttacatccaagagctgttgaacaatatcgagtttcccaacrtatgtgtgattggaatcaaaggaggagaagaaagggagacagttcagaagataatatctgtggaaataatggctgggaattttcaaaaaataatgacagaaaccaaaccacagatccaggagtctcagagaacagcaagaacaaaaaaacaaaaaacactcactcctctccctacatacacatgctgtggcatagcataa

SEQ ID NO: 137 - DNA, 401 bp, Homo sapiens
ggaggagaagaaagggagacagttcagaagataatatctgtggaaataatggctgggaattttcaaaaaataatgacagaaaccaaaccacagatccaggagtctcagagaacagcaagaacaaaaaaacaaaaaacactcactcctctccctacatacacatgctgtggcatagcataaaaccaaaaaaacagacaaaaycttaaaggtagtcagagaaaacraaacattacataaagmggaacaaaggtacagtggtgcaaagaattacagtaaactttttgtcagaaactatgcaagccagagacaatggagcaacaactctaaagtgctgaaagaaaagtatttgttaaccaaaaattctacaccttgtgaaaataccttaaaaactcaaggtaaat

SEQ ID NO: 138 - DNA, 401 bp, Homo sapiens
tcagaagataatatctgtggaaataatggctgggaattttcaaaaaataatgacagaaaccaaaccacagatccaggagtctcagagaacagcaagaacaaaaaaacaaaaaacactcactcctctccctacatacacatgctgtggcatagcataaaaccaaaaaaacagacaaaaycttaaaggtagtcagagaaaacraaacattacataaagmggaacaaaggtacagtggtgcaaagaattacagtaaactttttgtcagaaactatgcaagccagagacaatggagcaacaactctaaagtgctgaaagaaaagtatttgttaaccaaaaattctacaccttgtgaaaataccttaaaaactcaaggtaaataaagattttcttagacacacaaa

SEQ ID NO: 139 - DNA, 401 bp, Homo sapiens
gtggaaataatggctgggaattttcaaaaaataatgacagaaaccaaaccacagatccaggagtctcagagaacagcaagaacaaaaaaacaaaaaacactcactcctctccctacatacacatgctgtggcatagcataaaaccaaaaaaacagacaaaaycttaaaggtagtcagagaaaacraaacattacataaagmggaacaaaggtacagtggtgcaaagaattacagtaaactttttgtcagaaactatgcaagccagagacaatggagcaacaactctaaagtgctgaaagaaaagtatttgttaaccaaaaattctacaccttgtgaaaataccttaaaaactcaaggtaaataaagattttcttagacacacaaaaatggtgagaattcat

SEQ ID NO: 140 - DNA, 401 bp, Homo sapiens
taaatattagctatacttgcctaggtataggtgtagtaggtggtgaaaatggaaataatgaaggtaaaattaaattaattttctaaatattcttaattactctaaaacaatggttctgaaccccaggagatccctttccattacgattcttccccatgggaacactggcaatgtctggagacatttttgattgtcacagcyggggtggtgctactaatgctagtaggtaaaggtctgggatgctgctgaacaccctactatacatgggacagactcacacaaacagaattctccagtccaaaatattaatattgctgaagtttagagaatctgctctaaaagataacttctaaagcaaaaacagtaacactgtattgtgtgtttacagtatatataaaagt

SEQ ID NO: 141 - DNA, 401 bp, Homo sapiens
agagaatctgctctaaaagataacttctaaagcaaaaacagtaacactgtattgtgtgtttacagtatatataaaagtagagggtatgaaagcaatagtacgattaatgggggggaggaattgggactaactattgtgatgtccctacatagcacaggaaacaatgttatttgaaggtaggctcttgttaattaaagacgyatattttaaaacctaagacagccaataaaaataattaagataaaatggaataataaaatacattcaattaaaaaagaagagcctgaaaaggagagcagaaactaaagaatagatagaacaaatataaaacagctagcaagatggtggattttaattgagccatttaaataaccacataaacctcatttawtgagacctga

SEQ ID NO: 142 - DNA, 401 bp, Homo sapiens
attaaagacgyatattttaaaacctaagacagccaataaaaataattaagataaaatggaataataaaatacattcaattaaaaaagaagagcctgaaaaggagagcagaaactaaagaatagatagaacaaatataaaacagctagcaagatggtggattttaattgagccatttaaataaccacataaacctcatttawtgagacctgaattaacttaaaaccaaatcaaagacatgacaaaagaaaaatgttatgtcattatccctcatggacatatctatccacatcaaaatacattagtcccacttattggtgggggatattttccaagaccctcagtggattcctggaactgcagatgataccaaaccctatatatactatgcatgaatttcttg

SEQ ID NO: 143 - DNA, 401 bp, Homo sapiens
cagtggattcctggaactgcagatgataccaaaccctatatatactatgcatgaatttcttgttccttcttcacaacagataaagtcacagatggaaaattagttttcatcatggatcttagtaacttcagcatacgattttttttctttccatattaagtcaagaactttcaccttttcacttaaaggaggcactgatgscttcttttttggtagatctgaatggctagcatcactactcttgtgctctagggccattacaaagtaaactaagaatgacttgaacacaarcatcacaatactggatactatgatggttggtctgataaataagacaactcctgagtgagtaacaggtgtgggrgagggtacagacacatggataccctggacaaaaggag

SEQ ID NO: 144 - DNA, 401 bp, Homo sapiens
gatggaaaattagttttcatcatggatcttagtaacttcagcatacgattttttttctttccatattaagtcaagaactttcaccttttcacttaaaggaggcactgatgscttcttttttggtagatctgaatggctagcatcactactcttgtgctctagggccattacaaagtaaactaagaatgacttgaacacaarcatcacaatactggatactatgatggttggtctgataaataagacaactcctgagtgagtaacaggtgtgggrgagggtacagacacatggataccctggacaaaaggaggattcaccttcctggtggggcagagccaggcggtgtgagattttgtcatgctatccagagtggtgtgcaatttaaaatgygtgaattgtt

SEQ ID NO: 145 - DNA, 401 bp, Homo sapiens
agaactttcaccttttcacttaaaggaggcactgatgscttcttttttggtagatctgaatggctagcatcactactcttgtgctctagggccattacaaagtaaactaagaatgacttgaacacaarcatcacaatactggatactatgatggttggtctgataaataagacaactcctgagtgagtaacaggtgtgggrgagggtacagacacatggataccctggacaaaaggaggattcaccttcctggtggggcagagccaggcggtgtgagattttgtcatgctatccagagtggtgtgcaatttaaaatgygtgaattgtttatttgtggaattttccatttaatatttccagaacaccactgaccataggtaactgaaactgtagaaagtgaa

SEQ ID NO: 146 - DNA, 401 bp, Homo sapiens
ttgaacacaarcatcacaatactggatactatgatggttggtctgataaataagacaactcctgagtgagtaacaggtgtgggrgagggtacagacacatggataccctggacaaaaggaggattcaccttcctggtggggcagagccaggcggtgtgagattttgtcatgctatccagagtggtgtgcaatttaaaatgygtgaattgtttatttgtggaattttccatttaatatttccagaacaccactgaccataggtaactgaaactgtagaaagtgaaaccatgaataagaggagactattgtattggcaagttgaatatagcaattttcaactttttattwaaaaagttgaaaattactaggctgggtgcagtaattaaaattaaaaaatttaa

SEQ ID NO: 147 - DNA, 401 bp, Homo sapiens
caggcggtgtgagattttgtcatgctatccagagtggtgtgcaatttaaaatgygtgaattgtttatttgtggaattttccatttaatatttccagaacaccactgaccataggtaactgaaactgtagaaagtgaaaccatgaataagaggagactattgtattggcaagttgaatatagcaattttcaactttttattwaaaaagttgaaaattactaggctgggtgcagtaattaaaattaaaaaatttaaaaatattaaaatttttattttaatatttttaaattaaaatatgtaaaaatactaggctgggcgcagtggctcatgtctgtaatcccagcacttcaggaggccgaggttggggaactgcctgaggccaggagtttgagaccagcctga

SEQ ID NO: 148 - DNA, 401 bp, Homo sapiens
gggaactgcctgaggccaggagtttgagaccagcctgaccaacatggtgaaaccctgtctctactaaaaatacaaaaattagctgggtatgggggtgtgcctgtaatcccagctacttgggaaactgaggcaggagaatcacttgaacctgggaggcagaggttgcagtgagctgagatagcaccactgccattcagcctrggtgacatagtgagactccatctcaaaaacaaaaacaaaaacaataaacaaaaaaacactacacagtgaagtgaggcttacatgggcatgtcatgctggttcaatactaaaaaaattcagtcaatgtaactcatcatattaatgatgtaaagaaaagccacttgatcatatcgacagatgcagaaaaagcatktgaaaaa

SEQ ID NO: 149 - DNA, 401 bp, Homo sapiens
tcagcctrggtgacatagtgagactccatctcaaaaacaaaaacaaaaacaataaacaaaaaaacactacacagtgaagtgaggcttacatgggcatgtcatgctggttcaatactaaaaaaattcagtcaatgtaactcatcatattaatgatgtaaagaaaagccacttgatcatatcgacagatgcagaaaaagcatktgaaaaattcaccagccattcatgatgaaaagtgtcagcaaactactaacagaaggaacttcctcagcctgataaagggcatataaaaaaactgtatagctaacatcatttttaatgctgaaagactgaattcttactctctgaaatcaagaacaaagcaggaacgccactctccccagtcctataatttacagcactag

SEQ ID NO: 150 - DNA, 401 bp, Homo sapiens
ggaacttcctcagcctgataaagggcatataaaaaaactgtatagctaacatcatttttaatgctgaaagactgaattcttactctctgaaatcaagaacaaagcaggaacgccactctccccagtcctataatttacagcactagatgtcttaactagtccactgaagcaataagaagaaataaaaggcatggaggttgraagaagaaaaaaactgcccctatttgcagacaacatgaacatttataaaatctaggaatttagaaaaaggcttctagaatgaaaagtaggtttatcaaaattgcgggacacaggccaatacccaaaaccaactgtttttccataaactggtaacaatcggaaaccacaatctgaaaatgatatcatttactatagctcca

SEQ ID NO: 151 - DNA, 401 bp, Homo sapiens
cccagcaagttttttcttgtaaataaagacaagctgattctaaagtttatatgcaaaagcaatggaactagaatagctaaaacaacttagaaaaagaatacagttagaggaatctcattactagattttaagacttactataaagcaacagtaatcaaggcaatgggatagacacatagatcgatggaacagaaaagataycccataaatagaccttcacaaatatggtaatttgatttttgataaaagtgtaaaataattcaatggagaaagggtggtcttttcaacacatggtgttggaacaatctgtcattcacatgcaaaaggagacatgcatcctcaactttatccctcataccaaaaattaattgactcatagctctaagtattcactgtaagac

SEQ ID NO: 152 - DNA, 401 bp, Homo sapiens
tcacattgctgtgtgcctagtgctgtatccgcctatgttgctgccttgagaatgcagcttcatgactgggacttgcttcagtctagggcagggagaacaaaaagaggaaaaaaaaatgaggatttgcccacagatcctccatcccacgggggcccttctttcaggttttctggttagaaacagaggatttctctgggaacyttttctgcccacagttgctgtgcagttcctggatttgcattgccctgcagtctaagctggaagatatggaatgaaaagatgtcaggaaattcactgccctctgggttactttcaggatttgattttcttcccaaatatgcctgctattatttactaatcagcctccagatgctcactttatgtattctgtccaaggattt

SEQ ID NO: 153 - DNA, 401 bp, Homo sapiens
tgcatttaacatctgctagccacagagaagacaaaccttgtagctgtagaagaccccaaactgctgcagcccttttgagctctctgagccagagactccctgtattgcttctgggcaataccacctggacacatgtgccccctcaccgatccccgtctcccctggaatttcccttgccctcttcttctgggtgtctctggramgtcttctgctgtgaggactttcccttttctgcaatcctgtccaataaagcttgcgttgtgcaatattgccttcttgttctatctttctgtcttttctttgatcagcccccagatcctcaaactcaccattgttctctgctattatttttcttttaatgygcattaatacacacacatatatatacacacacatataca

SEQ ID NO: 154 - DNA, 401 bp, Homo sapiens
catttaacatctgctagccacagagaagacaaaccttgtagctgtagaagaccccaaactgctgcagcccttttgagctctctgagccagagactccctgtattgcttctgggcaataccacctggacacatgtgccccctcaccgatccccgtctcccctggaatttcccttgccctcttcttctgggtgtctctggramgtcttctgctgtgaggactttcccttttctgcaatcctgtccaataaagcttgcgttgtgcaatattgccttcttgttctatctttctgtcttttctttgatcagcccccagatcctcaaactcaccattgttctctgctattatttttcttttaatgygcattaatacacacacatatatatacacacacatatacaca

SEQ ID NO: 155 - DNA, 401 bp, Homo sapiens
ctggaatttcccttgccctcttcttctgggtgtctctggramgtcttctgctgtgaggactttcccttttctgcaatcctgtccaataaagcttgcgttgtgcaatattgccttcttgttctatctttctgtcttttctttgatcagcccccagatcctcaaactcaccattgttctctgctattatttttcttttaatgygcattaatacacacacatatatatacacacacatatacacatatatacactctttggaattcttttccttgtatgtctcttcaatattctctcacacttccttcaaatgtctgcccaaaccttgcttctcaatgagtccttccttgaccaccctttctgatactgcaacctgccttccattttacctccctgcttttcca

SEQ ID NO: 156 - DNA, 401 bp, Homo sapiens
tttctctgctaatagatctataaaatgtggaaagagatgttttacaatctctcatagcaatcctattttttgttttacataatttgatgcttttatatgaaacataaagtttcatggctattataaattttatgtagattttgcctttcatgaatataaaatgaccttcttttctatggaaaccttttttttttttttttwaccttatattaaattttgtttgaaatcaaaggggccatcctttctgtttttaaaatttcatttgtctggtaagcctttgcttattctttcaaaacatttctcattttaatgtgtctctttaagcttaaatagcgtatgtctagatttttaaaatctttttttaaatggggagttgaaataacttaaatgtattatcataa

SEQ ID NO: 157 - DNA, 401 bp, Homo sapiens
gcccaccactcacctcctgcttttcagcctggttcctcccaggccctggactggtatcagtctgtggcccagggattggggacccctgctatatacaggggtaaaaaaagagggaagaagagagaatttggttaaaatatattcatagaaggaaggaagtgtgaagagaaatcacggtccttattgcttccattggttatrtggttgcagatccatgctgcccagtgaaagttcttgtaatgatgcaaatagtttgtacctgcactgttcaatgcagaagccacctgtggccagcaaacactcaaaatgtggctggtgaaatgagaaactaatattttaattgcatttaattttaattaatttacatttggatttaaatagccacrtaaggctggtggctc

SEQ ID NO: 158 - DNA, 401 bp, Homo sapiens
gcttccattggttatrtggttgcagatccatgctgcccagtgaaagttcttgtaatgatgcaaatagtttgtacctgcactgttcaatgcagaagccacctgtggccagcaaacactcaaaatgtggctggtgaaatgagaaactaatattttaattgcatttaattttaattaatttacatttggatttaaatagccacrtaaggctggtggctccaatgctgtacagcgtagctgtgaatagaatgatattccctttgtcttcagccatacgtcagtgaactgggatctctcccagtctaattctttgctcaatttcaggacaaccgagaaacctagctaattttgcctctatgagacttccatagtcattcactcaaaactcatcattgaacatgtta

SEQ ID NO: 159 - DNA, 401 bp, Homo sapiens
ctaggtcagaaacaatatcctttgaggcaccatgcctgtcatgactatatatgaggtattcagtaatggttgcacttgtagaagcatagttgggaaggaaagcatatcaaagtccaaataataagtgaagataaatggcacctttatcaggaaggaaggttgccaatgcaattaaccttgtgctaggtagctggctaggtrgctatcccccaaaggcatggtattatattgggggctccaggttggtcttttaatgggaaagttgagcaaacagcagatgtgttatctagggaagagagggttggctgacaatagagaaggtmattttatctacctgattattaaaagcatccctgcactgggtattcacgtttgatacaaatattctctccctttgggcc

SEQ ID NO: 160 - DNA, 401 bp, Homo sapiens
aagtgaagataaatggcacctttatcaggaaggaaggttgccaatgcaattaaccttgtgctaggtagctggctaggtrgctatcccccaaaggcatggtattatattgggggctccaggttggtcttttaatgggaaagttgagcaaacagcagatgtgttatctagggaagagagggttggctgacaatagagaaggtmattttatctacctgattattaaaagcatccctgcactgggtattcacgtttgatacaaatattctctccctttgggcccattctgagggtcctctagaatagtagctgaaattggggttaaaagctgcttaaattttgacagtctgctttacttctctaaataccagacatcttcaccaggttattcccttgatcttgtg

SEQ ID NO: 161 - DNA, 401 bp, Homo sapiens
attgaatcaatttgcatttaaatcctactattgtgattttatctttttgaaaattatcctaccttgagtcttttttctctcttttctatgcatattagtcttttattcttagtcttttttttttctttgtatcttggctttctgcttctgtttcatagaagtcatgcattctaataagtatggcaaactaatggaaatttytcctttctttagcaaatcattttcagatatttgttatccttgtacatttttaaggtgatctttcctttcattttcattgcagtattttaaaaatcaactttagtgaggtatcatttacatttattaatatacacccattttaaatgaacacttcaatgccctttgtatatatccatatattcactaccacaatcaagata

SEQ ID NO: 162 - DNA, 401 bp, Homo sapiens
atgttcagtggtaactcttcattctaggttgtcagaactcagatacctcctgtactgcctgaggaagttgttcagcttccagcttccctgtaggtttttcctagaagccattctttgcctggttagtcctacgttgcctgttgttcaatgtctgaaagtagttgttacatatattttgtctagatttctagatgtttatgrtcggaagcctagtctggtactggtacatcatcatggctggaagcaaaaatcatattgtagtattttcttttttaatttttattttttgagtcagggtcrgggtctcactttgtcacctaggctagaatgtagtggtacaatcatagctcactaaaacgtcatactcctggcttaagtgatccttcctccccagcctgctg

SEQ ID NO: 163 - DNA, 401 bp, Homo sapiens
cctagaagccattctttgcctggttagtcctacgttgcctgttgttcaatgtctgaaagtagttgttacatatattttgtctagatttctagatgtttatgrtcggaagcctagtctggtactggtacatcatcatggctggaagcaaaaatcatattgtagtattttcttttttaatttttattttttgagtcagggtcrgggtctcactttgtcacctaggctagaatgtagtggtacaatcatagctcactaaaacgtcatactcctggcttaagtgatccttcctccccagcctgctgagtagctaggagtataggcactcaccatcaggcccagctgattcattgttttgttgttgttaaagatgggctcccattgtgttgtccaagctggtcttt

SEQ ID NO: 164 - DNA, 401 bp, Homo sapiens
ctcaggctggagtgtagtggtgtgatcttggctcgctgaaacctctgtctcccaggatcaagcgaatctcctgcctcagcctcctgagtagctggattacaggtgcatgccaccacacccagctactttttgtatttttagtagagacagggtttcaccatattggccaggctggtctcgaactcctgacctcatgatccrcccgcytcggcctcccaaagtgctaggattacaggcatgagccacagcacctggccatattactctttttagaaaaccagtctaattatttcttttctttttttttttttttttttttgagacagagtctctttctgtcatcaaaactggagtgaagtggcacagtcaccactcactgcagccttgacctcctgggctta

SEQ ID NO: 165 - DNA, 401 bp, Homo sapiens
ctggagtgtagtggtgtgatcttggctcgctgaaacctctgtctcccaggatcaagcgaatctcctgcctcagcctcctgagtagctggattacaggtgcatgccaccacacccagctactttttgtatttttagtagagacagggtttcaccatattggccaggctggtctcgaactcctgacctcatgatccrcccgcytcggcctcccaaagtgctaggattacaggcatgagccacagcacctggccatattactctttttagaaaaccagtctaattatttcttttctttttttttttttttttttttgagacagagtctctttctgtcatcaaaactggagtgaagtggcacagtcaccactcactgcagccttgacctcctgggcttaagcgat

SEQ ID NO: 166 - DNA, 401 bp, Homo sapiens
gtttacatttctaccataagtatatctttctcagtattttagtaagaaatgtggtaagcattaaaatttaaaccaggctgggtgtggtggctcatgcctgtaatgccagcactttgggaggccaaggtgggtggatcacgaggtcaggagttcaagaccagcctgaccaacatggtgaaaccctgtctctactaaaaatayaaaaattagccaggtgtggtggcacgcgcctgtgatcccagttactcaggaggttgaggcaggagaatcgcttgaaccccaggaggtggagatggcagtgagccgagattgtgccattgcactccagcctgggcaacagagcaagactccatcaaaaaaaaattaaaccagaaattccctttattcatttttagcccaga

SEQ ID NO: 167 - DNA, 401 bp, Homo sapiens
tcatttatatctcattaactagtttcctgtttttattttaaaacccagatatcacagtgaaatttaaactcatattcataaaggaaaacaatctgcaaagtccaatctagtttatatcattagtaagaataatagtatggtttaaataagatctatatatttttactaatattcgttctgctttcacaaatatattgccaygtgtagayctctccttcataccaagagttcagttggcaccatgaacagttcaaaacactaatacttgtgatcacagtattggttcttaattaaacgtacaattcccccccacacactatttatggattgctaaaacaatattttcacctttatctttggctgtcagatagcaagttggacagtgaagtagaactgacaga

SEQ ID NO: 168 - DNA, 401 bp, Homo sapiens
atctcattaactagtttcctgtttttattttaaaacccagatatcacagtgaaatttaaactcatattcataaaggaaaacaatctgcaaagtccaatctagtttatatcattagtaagaataatagtatggtttaaataagatctatatatttttactaatattcgttctgctttcacaaatatattgccaygtgtagayctctccttcataccaagagttcagttggcaccatgaacagttcaaaacactaatacttgtgatcacagtattggttcttaattaaacgtacaattcccccccacacactatttatggattgctaaaacaatattttcacctttatctttggctgtcagatagcaagttggacagtgaagtagaactgacagaaatgaaga

SEQ ID NO: 169 - DNA, 401 bp, Homo sapiens
atgtgtaacaatactcagttagtattgccaactatgtgtctgttgtcacatggcactatttaacactgagctgtggtgaccagagttttcagttgggtttcagacacatagaatggttggctaactcaatctccagcccctctggaggcagagctgatactgtgtaacccaaaacttctaccataaatcccattgctagawgatctgggatggcccaaggctcttagctaaactaagacagtcctgtcaggcagaacattctaagggttcagagattgtctcccaggatccaaggacaaaggtcagacctctctttgggcaagattaaattctgtattacacaataccagatgagcagctgtcttttgatggctgtaaatggatagtgaaggatattttca

SEQ ID NO: 170 - DNA, 401 bp, Homo sapiens
gtctccatgtcctgtagttcacctttttgagatgcccaggtgggaaggactccctggcagaacttccaacagacctgtgcgctgggagcaacgcgcactcgggtggagtcttgggaagtttgccccgtttccagtggggaggagcctggaccccctcttcctgggtggaacctgggattcagcctgcggggcagcaagcaygctagcaggactctggctttgagaagggtccctttttccccctttttgcccaataaatttcattttttctcacccttcaaagtgtccgcgagcctaatctctgatggtcatgtgacaagaacccggctcttagctgaactaaggaaaatgtcctacaacatttcgacataaacagccaaattccattctattttaatact

SEQ ID NO: 171 - DNA, 401 bp, Homo sapiens
gatgtaggtctttaacaattatgctaagtgaaataatccagacacagaaaaacaaatagcatgtggtctgtcttatatggtagaatctaaagaaggtgaatttgtagacggagagaattacagtggtgcttgtcaggcactgggtagcaggatggtttagagggaattggagagctgttggtcaaagggttcacgctttcwgttataagaacaacttctggggatctaatataccatatgagtggtgatggatgtactaattaagttgattatggtaaccattcacaacgtatatgtacatcaaatcattgttttgtacaccttgaacgtattcaatctttatcaattaaatattttaaaataaagaaatagatggggaaatatatttattgaacacctat

SEQ ID NO: 172 - DNA, 401 bp, Homo sapiens
gcttttttttctagtataaagagttcaattagggtaactctgccccttacctcatttgtcctggtgatacgtatgaaataacaccaatttgctagttagattaattgtgattagtgattagattaattgtgtgcactccacttcttcttgctcatcttccttttaggaggaaggctgcccttggaggggaaatgttccctmtgttcctttcgcccatgagaatgggcctgctgtcttgtccactactgcctgtgactggctcagaagtgggcctaatgctgggattcattgaatgtgccttcctacccagctgtatctttgtaaatattgatcttttagtttctatctttaatcttttatgtttatttttcaaatttttcagaagcttatttgggaagaag

SEQ ID NO: 173 - DNA, 401 bp, Homo sapiens
tttaaaaccaacccccgtgttctcttcacaaattgaagagtggagatttttggaaagtattacaccccttcttccccttcctagcatggataataaaatctcactctctttttgtcacacttcactcttgttatattggcttctttttacaagctacaagcagccagacccttttgccaattacatgcccattatgaggcytatggaaaatgttgtgattaaaggagttccttttccatgggcaccccatgtgtacttctgcaaaatggaacaatagcttgaaaagccttaccagatttgctgtctcagcttcccctgtgggtcttactgatcaaggacattatagtaaataaaaaaaaaatgagagagacaaagaagagagtcatggacttgtcccagca

SEQ ID NO: 174 - DNA, 401 bp, Homo sapiens
tattgatggtgttgaaacaaaagtattaatgcagcactattgaaggttagatgaaccaatgggactttctgtttgtctcccaacattgaaaggctccaacaagttttctccatttaccccagtttggagaaacttaaaaagtcagagattactcagaactggttggggtgacggttaagcaggttaatcaagattgatgargggccagggtctcctggccagacctcaggctggcaggggtcccaaggacatatgcacatgtgtagataaaatggtcagtggaaggagaagagacttttctgggactccttggtataggaggtcaatgcattgtaattccaaaagctgttggtgaagacttaacaggagttaaagttaagattgggggagtatatggagct

SEQ ID NO: 175 - DNA, 401 bp, Homo sapiens
aaacagtagattattgaggcttaaatacataaatttgtacctcagtacaattttatagcctcagtaattttagtcatgatttcaatcatacaaaaagactgctactcagtgatcgaccttgcaaacattcttctctcagtctcagaaagtgccaaacactgtttgctcttatatgggaaggatcccagtttatgtatactrtgctaccatagggtcatctgaactcactggtttactgtcataatttggtcagaagggatttggatttgatgtaggtctcaagtgtaataatacactatattgatgatgagatgataatattggaaactaaagagccaggttaagactgagttgaatgcagcgatgactcacatgaccaaccaaggctgatcagtaaattc

SEQ ID NO: 176 - DNA, 401 bp, Homo sapiens
cacttttctgggggatctggcaaagcaggggtggaaatctccctcctgctgccagtgtggttatatgatttttcccatataatctcactttttttttgtcccagtaagaagcactggagcactgcctgatgccaagggtcctaggaccagggatgtgactgtgtacatcctcgtaagcaaggatgatttctaggcaagaargtgtaactaacttttaaacatctatgccagaagtcctaagggcctgatagtgtgaattcacatctgtgaatattgctgtgttgcctagggattgggctagccctgacatccccgataggacagttctgtacccaggtaacctgaccctatctgaatggaaatggactgaaagggaggcatttgttagactagcatcactg

SEQ ID NO: 177 - DNA, 401 bp, Homo sapiens
cctctggtaggattaaagaagttggcatcacattgtagatccaagttcccctggggaatgaccccactcgaaataaggaaggctgtgagaggccttatggcacactcaaattaaattacatctacctgtaaacaccaatcatctaactctagtgtggggacccaaaattttttgcaaaacatttatcctaactgcattcgygccattagtacgcaataccaatgatatgcatggtagattaaacaacactggctcctaagacagaaaagggcctcaggagagataggtgcaggtctaggtatcctgggacaagctgagtttactcttaatgtggagcagcattcggaggaaaaagatttattaactagaagagacagaatagaggaaattctcttcaagga

SEQ ID NO: 178 - DNA, 401 bp, Homo sapiens
cttctcaaaagaagacatttatgcagccaaaaaaaacgtgaaaaaatgctcatcatcactggccatcagagaaatgcaaatcaaaaccacaatgagataccatctcacaccagttagaatggcgatcattaaaaagtcaggaaacaacaggtgctggagagggtgtggagaaataggaagacttttacactgttggtgggrctgtaaactagttcaaccattgtggaagtcggtgtggcgattcctcagggatctagaactagaaataccatttgacccagccatcccattactgggtatatacccaaaggattagacatcatgctgctataaagacccatgcacacgtatgtttattgcggcactattcacaatagcaaagacttggaaccaacccaaat

SEQ ID NO: 179 - DNA, 401 bp, Homo sapiens
ggaacctgaggacctaccacttgtgattgaatctgaagttgggggcagtctggtggggctacagccttaacctgtgcagatactaattccagttagtgtcagagttgaattgaatcataggtcatctagctggtacaggagaattgtacagtgtgggaaaaaaaatccatatctgactacagtagtgtagagtgtgagtayagagaaaaacagttgatttttcctatacattttatgtcagaagtgaagcacgtattgagaatggtgtgagtatagaaggaaaagcagtttgtgtttctctatatacaagcccaggccacatggagagatatgtgcaggtattctagccgacaaccccagctgaggtctcagctgatagaatcaacctccaactataagtg

SEQ ID NO: 180 - DNA, 401 bp, Homo sapiens
ctaacctaccgagcctgctgaaattgcagattatgcgaaaactaaatatagccgttattttaaaccactgcattatgaggtaattattatgcagccacacaaacaggaatggaacccattttattcaatgacagcttctgccactttgctgaagccttaatcatgaattatatggcaagaagtagatttacatttatgaayaggtcaagaggaaagaaatgaagtcttgttagaacaactgtgtttctggaaaaactttttctctggtaaaagtttcagcaattgtgttagtttctcgtggctgtcgtaatgttaccaccaatttggtggcttaaaacagcagaaatttatgctctcacagttctggaggccagaaatcagaaattggtatcactggtgac

SEQ ID NO: 181 - DNA, 401 bp, Homo sapiens
ctggaggccagaaatcagaaattggtatcactggtgacaccatgatgaacctggacaacattatggcaagtgaaacaaggcagacacagaaagataaatacaggctgatctcattcatatgtgaaatctcagaaagttgaacccataaaattagagagtaaaatggtagttaccagaggataggggaggggagtgaatagsgaaagggaagatatcgattaaaaggtacaaaatttcagctagacaggaggaatacacttagtgattcattgcacagaatggtgactataataaataataatgcattgtgtatttaaaaattgccaaaagagtagattctaaatgtttttaccacaaaaagggtaagtatggtaattagcttgatttgatcattccacaat

SEQ ID NO: 182 - DNA, 401 bp, Homo sapiens
aattctagaaacatataaaaggaattatacaccatgggtaagtaggatttattccaggaatgcaaagttagtttggcatctgaaaattaattagtataatatattgtatcaatagaattaaaaggaaaatgtatatgatctcaatagatgcaataaaagcatttgtcataattcaatactttccaagaatttatacaccaycaacaacccattaacctaggaatggaagagaacttcctcaatttgataaagagcatttataaaaagcccacagctaacactgtacttaatggtgaaagactagattattttctcttaagatcagaaacaagactctctgactgcttctatttgacattgtactggtggttctagtcagggcaatgaggcaagaaaaagaa

SEQ ID NO: 183 - DNA, 401 bp, Homo sapiens
ttttggcaccaggaagtggtttcatggaagacaatttttccacacactggtgggtgatgtgggggctggttttgagatgcaactattccacctcagatcatcaggcattagattctcgtaaggagtgcacaacctagatcccacacatgtgcagttcacaatagaggtcacactcctgtaagaatctaaggctggcactgwtctgacaggaggtggagctgagatggtaatgctcgcttgcccaccactcacctcctgctgtgaagcccgattcctaacaggccatggactagcatctagccatggcctgggggttggagaccccctgcttcaaaggacaccttcaagaaagtaaaaagacaggtcaaagaatgasagaatatgtttgcaaatcatatatc

SEQ ID NO: 184 - DNA, 401 bp, Homo sapiens
ctgtaagaatctaaggctggcactgwtctgacaggaggtggagctgagatggtaatgctcgcttgcccaccactcacctcctgctgtgaagcccgattcctaacaggccatggactagcatctagccatggcctgggggttggagaccccctgcttcaaaggacaccttcaagaaagtaaaaagacaggtcaaagaatgasagaatatgtttgcaaatcatatatctgataagggatttgtatctagaatatatacagagcatgtacaacccaataataaaaagacaacacaactaaaaatggacaaatattgaaaaccggaacaccacaaggatgcccactctcaccactcctattcagcatagtactggaaatcctagccagagcagtcaggcaagaga

SEQ ID NO: 185 - DNA, 401 bp, Homo sapiens
ctcatatctccaactcctttccctcatacacacaatagttttagaataacaatgccatgtgttctacaataataagagaagtgaaaattatttaagagcatttgccctattgtttttctaattctaaaagaaatacatatttaatatggaagagttataaaatagaaaaatcataaagaacaaaagttatttataatccartaacccatgtattatcaatgtgaacattttggaacatttgttattcttgaaaatggtttagatagtaaacttttgaatacaatgagcacctgtcccattatgtattttaaatgggagaataatgatgtgttctcagcttatataaaagtcccgaaccattcttcaaatattactaaaatattcttaagcatctatagaaa

SEQ ID NO: 186 - DNA, 401 bp, Homo sapiens
ttctgcagggcagatgctggctagttaagcttgcctgtaaatcatagtttgtccataaactccagcatattctatttagaaccacagagcgaaaaactaataaatacatttaaaaatcttagtagacattaactccagagaggttcttaatttttaacttgatcaaaattttagctatgtcttagtggtttggttgaattwtaagcagatattgagaactcgcattgctttataaaatgcttgggccgcatgtggtggctcacgcctgtaatccmagcactttgggaggctgaggcaggcagatcacttgaggcgaggagttcaagacgagactggccaacatggcaaaaccctgtctctattaaaaatacaaaaattagctgggcgtggtggtgggcgcc

SEQ ID NO: 187 - DNA, 401 bp, Homo sapiens
tttagaaccacagagcgaaaaactaataaatacatttaaaaatcttagtagacattaactccagagaggttcttaatttttaacttgatcaaaattttagctatgtcttagtggtttggttgaattwtaagcagatattgagaactcgcattgctttataaaatgcttgggccgcatgtggtggctcacgcctgtaatccmagcactttgggaggctgaggcaggcagatcacttgaggcgaggagttcaagacgagactggccaacatggcaaaaccctgtctctattaaaaatacaaaaattagctgggcgtggtggtgggcgcctgtaatcccagctactcgggaggctgaggcacgagaatcgcttgaacctgggaggcagaggttgtggtgagccg

SEQ ID NO: 188 - DNA, 401 bp, Homo sapiens
aaccctgtctcttctaaaaatacaaaaattagtcaggactggtggtgtgtgcctatagtctgcactacttgggagactgaggcttgagaatcacttgaaccagggagacagaggttgcagtgagctgagatcatgccactgccctccagcctggccaacagagagagactctatcttaaaaaaaaaaaagttataaaaaasaagtgatttgaaaaagaaaaagggctttaggaaggacacagaatataaacaaatctcctgtcctcatgacacttaagatttatagggattcctaagtctcctgtactgcatactcaaaatgcagggtcctaagacttacaggaaatattatactcaaatgcactttcttcattcctgtcttgaccatctgtgctgaatcc

SEQ ID NO: 189 - DNA, 401 bp, Homo sapiens
aaacgaataagaaatgtaaatatcctggctgctaattccttgtaagtctagaaagtggttaggtatttgacttgtctcctctggttcttaccctggccattcttgttgctaagaaggaatgatgtctcctgcaaagagcccaccaaacacatttctaccctaagtagcctgctcaaaactcatcaaaagccctactaagaygttttgctgcactgaaccctttcattttatagtttcctcatttagaattccctttcacacgtccattcattcattcaacaaatattaagggtctactatgtgccaggcctggtagtaagaatttggtatagacataatattccttcaagaagcttaaagccaggcacggtggctcatgcctgtaatccccacactttggg

SEQ ID NO: 190 - DNA, 401 bp, Homo sapiens
catggctgcatgaaatgaacaggcacttttctaatatgaacatacagtgaatgaattaataactgtatgtttctaagagccacatttctgttagaactagccatataaggcatatgactaatgaattcagatatttaatattgaagtttaggaaaatgtcatttccactgggctgagaattagagtcaggagcaaatcttyctatctccctctyctacacattcattcattcagcattgtgtgcctattatatgtcaagatagtataatgtatatatttaatattatatatagtatagtataatacatattggcacataaatatgttttttatatatatataatcatcgayagtaacatgtttataggcaatagcaattcaatgtggcaagttttatgaca

SEQ ID NO: 191 - DNA, 401 bp, Homo sapiens
aatgaacaggcacttttctaatatgaacatacagtgaatgaattaataactgtatgtttctaagagccacatttctgttagaactagccatataaggcatatgactaatgaattcagatatttaatattgaagtttaggaaaatgtcatttccactgggctgagaattagagtcaggagcaaatcttyctatctccctctyctacacattcattcattcagcattgtgtgcctattatatgtcaagatagtataatgtatatatttaatattatatatagtatagtataatacatattggcacataaatatgttttttatatatatataatcatcgayagtaacatgtttataggcaatagcaattcaatgtggcaagttttatgacaaggccatacacag

SEQ ID NO: 192 - DNA, 401 bp, Homo sapiens
ggaaaatgtcatttccactgggctgagaattagagtcaggagcaaatcttyctatctccctctyctacacattcattcattcagcattgtgtgcctattatatgtcaagatagtataatgtatatatttaatattatatatagtatagtataatacatattggcacataaatatgttttttatatatatataatcatcgayagtaacatgtttataggcaatagcaattcaatgtggcaagttttatgacaaggccatacacaggatgctatggagcatggaaaggaaggagtccctgagaacatgtcatcgaaactgacttcaaatggagatgtaggtatgagctggttgttagaaacggaatgtttgtgtcaccccgaaattcttgtgttgaaacccta

SEQ ID NO: 193 - DNA, 401 bp, Homo sapiens
tattttgttatggtagccttagcaggctaatacagtggtaaactctgcatatggaggagttgaaaaagagagagtagatggcaatttgggcagaaggggaattacctgcaaatgttcaagggagtggagataattcttcttaaactgtttatcagtccttcaggagataagttaacaacagaggataattatcccagagarctggtttctggcaaatgtctgaagggcatggtaggtcataaaatacccactggtggtattttatattctgaaaaccattttaatctacctttcatgacctggatgcttcagcctcctgtgcttcctcagaatttgataactgacccatgagacaaaaactgatcktttatctagaatcctctagattccagtacaactca

SEQ ID NO: 194 - DNA, 401 bp, Homo sapiens
gataagttaacaacagaggataattatcccagagarctggtttctggcaaatgtctgaagggcatggtaggtcataaaatacccactggtggtattttatattctgaaaaccattttaatctacctttcatgacctggatgcttcagcctcctgtgcttcctcagaatttgataactgacccatgagacaaaaactgatcktttatctagaatcctctagattccagtacaactcagcagctgtgaagcctctaaatttgcaacttgctttcttttaaactcagtagaatccctcagccagaaccaatcctcatgccaattttagaactgttcgatattcccaagaaaagaaaatggctggtgattgtcaactctcttaagaaagtctcttattttggggg

SEQ ID NO: 195 - DNA, 401 bp, Homo sapiens
caggcacacgccaccatgccctgctaatttttgcatttttagtagggacagggtttcaccatattggccaggctggtctggaactcctgaccttgtgatctgcccacctcggcctcccaaagtgctgggattacagctgtgagccaccgcgcccagctggaaatgttcttttgactctgaaattttagttcatcgagtccwcattgacttcacagctctctggtatctttaagtgtattatttttgtaatttatatgcttttttttcctggttactagcaggaacattgatccaccataaccaatttcatgtttctgagaagtgaagctcattttctgttaaagagaaagagagacatgaattccaaaacaggtaaaggtgtctataaaccagtaagttta

SEQ ID NO: 196 - DNA, 401 bp, Homo sapiens
aaagattgccttaggttaggccttatagcttaagaggcaaaaggaagtctcaagtctcctgtttgcttcagcccattaaccaggtttggagatcatacagaaaattaaggtttaagtgctaactagcagtgaaatgtaataaaaaactagttatgactctactgtggttttaaatggataaatgagatcgtgagtccaaasattcagaaactctgatactgttcatattgagagatttaactaaaaataagtttctgctggagagaagaatgaaaggtaagtacagaggaaggcaaggtacaaaggagattttctgagtccagtcagggttagcgtggagaccctgtgcacttggggaaatggaaaaagtggcaataaagagcaaattgtagatagaagca

SEQ ID NO: 197 - DNA, 401 bp, Homo sapiens
ggcaataaagagcaaattgtagatagaagcaatgaaggcccaaactggtaatgtcacacttttgctttgagcaggctggtaatgatttccccaggaaactcaactatgcaaataagaaagcttggaagtatgacttaacgattaatgaagctcacactactttgttcaatggaaaatttgttcttgtctaaatgtccagakagtaacttggttctttttctccagggttatgcagaacagaggagacgcttttctgccagctggaaggggtagcaggtggggtaatggattcccagcttgccagcggctgagattctaattagaatcttccttctggcttttagcaagcagctttcacttcatagtgtccttagagaagaaagttccatattcagcaagaa

SEQ ID NO: 198 - DNA, 401 bp, Homo sapiens
gtagaaggagaaagaaaagagagatatggaggtgagggagggtgaaaatgtgcaatagatgatgacagtgttggagaaggcagaggtttttgccataaagaatctctagctgggatcacttgaggccaggagtttgagaccagcttgggcaacaaagtaagaccccagctctataaataaataaataagtaaataaataartaaataaataaataaataaataaatcagctgggcatggtggtgtgcatctgtagtcccaactactcaggaggctgaggcagaaggatcccttgagcctaggagttcaaggctgcagtgagctatgatgtgccactgcactccagcctggggaacagagcaagatcctgtcttttaaagaggaagagagagagactgactc

SEQ ID NO: 199 - DNA, 401 bp, Homo sapiens
ttttgagattgttatttaaatgccgtttgctattaaactgtggttagaaaatctgctcagccaaaatgatgctgaaagagcattaagtttatgagtcacaaaagccagagtaattctaattactttcctgaacttcagtacaatagagatgtttaatatgcaatgggacactcctttaaaattgttgcaagacaggtgatmggagtcttggcttctctccccaccttgattatcagtgaagtaaaggttaggtgcggtattgtattgtgtgttttcatcttaaagtttcttcttctgcagaatgggttaatgatggaaacatttgggtattgtggtgcacagagtgggttctcgtgtctcttcagagcaaagtcctcttatacatcatcatgagcctcata

SEQ ID NO: 200 - DNA, 401 bp, Homo sapiens
tccagcaggacaagatgtggaggcagaaggcagtgctgttgatgatcctgaccttgtatggggttaggctaatgtgtgtgtttgtgtcttagtttttaacaaaaacgtttaaaaagtaaaggaaaaaaaatcttaaaaacagaaaagagcttatagaataaggttataaagaaagaaaatatttttgcacagctgtacggygtgtttatgtgttattacaagagtaaaaaggtttagaaaatttaaaaattgataaagttgaaaagttacagtaaactgagtttaatttgttatttaagaaagaaaaatattttctataaatctagtctagcctaagggtatagtgtttataaagtatacagtagtgtacagtcaagtcctaggctttacattcactcacc

SEQ ID NO: 201 - DNA, 401 bp, Homo sapiens
actcttataggagataacatcttctagaattattcttcatgtatcttatcttctacctccttttgttcatgtctttatcttcttctgctaattctgggataatttgttgagtttatcttctccagcactcattcatttcctgcatatctttcttactgccatcatccagttagtttggcattatgttttttgacctcactsggacctttctaatttaagtcttcctttgtgaatatttcccagctacagagatgccatggcttcttgaacccttctggaagagaatctaatattttctaaaaatttcttctgaattttggagtaaccctattttaaaaggagatattccatcattttttaaaacaatgactcacttattttggacaccactattttctcat

SEQ ID NO: 202 - DNA, 401 bp, Homo sapiens
tcccaatgccattcccaactcttctaaattcatctggggcttaatagactctccccatcccaactcttctaaattcatctggggcttaatagactttccccctcatagacttccatgataagctgctctgtttcacaatagggaagcttacacaggcctttccttcaatctcatcctgccctccctagctaacagaaattyctagaaatatctagccagtgagagcatccatttctagtttcatcctataatgttggttttcataatgttggttttaaatgtaattattcattacaaagtatttgtgagggagtagagaagaatgggtacttataataaaagcatgactttttaatgtatcaaaactatacagaaacaaagacaacatagagataactctt

SEQ ID NO: 203 - DNA, 401 bp, Homo sapiens
tactgtctgattaaaaataatatgacacatgacaggtacaagttacatgagaattcctttgacatgtgaatgaatggttctttgaagacagagtgcagtaaattccagtctataaaagagttttttgaataatatgatgaccaaacttgtgtgtccagggcaaaaggagggtacaaatagacagaatatgcaagatagagwaatgctggagttaagtctcagatatctttgaagcaagagtttcatccttaatttgcttggtgggcatgtgtttcttacatataagatttttatgtttctgaagcccagaggataagatggagaattcagctcagggttggcctaagggagggaggtgaactagcgagaaagaaaaaggtcccataagacaccccaggaag

SEQ ID NO: 204 - DNA, 401 bp, Homo sapiens
tgcaggaagaatctgttggctggttacaattttatattaagggagggtacccaagagaaaattctagcccatttctattgcttcatttttcacattgcatgcagtcagtggtgatgtactttctctctctctttttttagagagagagttcctttttttttttttttagagagttcctcattacttgttttgaacctaaasttataatttagtgtctgtgacagcacatttgattgtttttaaatgaaggtgataggaaaggcagaagaatgactagggaagaaaatctggagaacagatgacaagataacattgcttttgattctctgcaaacaagcatggtattgaaaaatgatccaaaatcgtttgcttgagcaccacagttacttttgagtaatatt

SEQ ID NO: 205 - DNA, 401 bp, Homo sapiens
gaccatcctggctaacacggtgaaaccccgtctctactaaaaatacaaaaattagccgggcatggtggtgggcgcctgtagtcccagctactctggaggctgagacaggagaatggtgcgaacccgggaggtggagcttgcagtgagccgagatcgcgccactgcactccagcctgggcgacagagcgagactcactctcmaaaaaaaaaaaaaaaaaaaaaaaaaaaggaaccaagttgtgagtgagaaggacctggaaaggcactgttagtggcagtggatccgtaggggtctgcaggaacctcaactcttgcgtcctcagaagaattcgacggaggaggcatgaggcagaaggagagacagaggcaagttttatagcagaagtgaaagtttatttaaa

SEQ ID NO: 206 - DNA, 401 bp, Homo sapiens
gaagagggccaagcaggtgacttgagagaccaagtgcgctgtttgaccttgacttacggtttagtatattggcatacttctggggtcttgtgtccctgatttcctgatttttccctggagggtgcgccgtctgtatgcgcagtggcctactagcgtttgggagaggccgtaggcgcagtgtgtttactggagttgtacgcrtgctccctagagtggttcttcccttcccggtctagcattcctaggggaaagtgatgtaccagttaagctctgctgttttgcctcttagtgctcatgcttgagcccactcgcccaattcctgaaatcttagggggaagcggctgatcaccagtttcagatttttcctatgtattgtgagactgcctttccctggcacaggc

SEQ ID NO: 207 - DNA, 401 bp, Homo sapiens
ctgcctcccataatgccagagtggtcaatttttagtatccttactgtgcaaccagctctcatgattgtacccagtcaaatctctataataaattatacatctctctacagacctggactgaaacattgctatttggtgttttaccctatttagagccaaaatatattttcataagaagaaactcacagctgtcacatgtawgtaagttataaactgatttcagaatctccaatacagaaaatagtaactttagtgttcctattgtttggtactctaataataattagagaaaactgagagtttgggattatgtgactacaggaaatacctgtaattgccaattggcttcataataagaaaattggcagggctaagaaggcccagggaattaagaatataaa

SEQ ID NO: 208 - DNA, 401 bp, Homo sapiens
aaggcttctggccccctccaatcccctctgcatctcactaacaggactggaagctgctgaaacagaggtattggaagcccacagatcatcaatatacagtttgaacttgtagtgaggtagacaagaataattcatagggatgtattatagagtaggtagagaaggctgactcctgacagtggcatatttgataaaaatccycccaaaggcatttagtacctggtaggctaatggctcatgagagaaaacacaagaaaggagatgatatgggagggtgggaaagccaatctttaggtaaaaaattacaagtcgtctttaaactatttactttaaaaattactagtttttctgctctgcatgctaatatgctactctttttttctcaactttattatttctct

SEQ ID NO: 209 - DNA, 401 bp, Homo sapiens
aattacaagtcgtctttaaactatttactttaaaaattactagtttttctgctctgcatgctaatatgctactctttttttctcaactttattatttctctttgaatgtatattagtccattcttacattgctataaagaaatatcggagactaggtaatttataaagaaaagaggtttaattgcctcatggtttcatagrctgtttgggtagcatggctggggaggcctcaggaaacttttaatcatggtggaaagtgaaggggaagtagggacgtcttacatgaccagagcaggaggaagagagagaagggggagatggtgcacacttttttttttttaagctttgtatctaatttggcaatcttattccagtatttttctttttctttttttttttat

SEQ ID NO: 210 - DNA, 401 bp, Homo sapiens
acatttgggttggttccaagtcttcgctattgtgaatagtgccgcaataaacatacgtgtgcatgtgtctttatagcagcatgacttctaatcctttgggtatatacccagtaatgggatggctgggtcaaatgatatttctagttctagatccctgaggaatcgccacactgtcttctacaatggttgaactagtttacygtctcaccaacagtgtaaaagtgttcctatttctctacatcatctccagcacctgttgtttcctgactttttaatgatygccattctaactggtgtgagatggtatctsattgtggttttgatttgcatttctcggatggccagtgatgatgagcattttttcatgtgtctgttggctgcataaatgtcttcttttgaga

SEQ ID NO: 211 - DNA, 401 bp, Homo sapiens
catgacttctaatcctttgggtatatacccagtaatgggatggctgggtcaaatgatatttctagttctagatccctgaggaatcgccacactgtcttctacaatggttgaactagtttacygtctcaccaacagtgtaaaagtgttcctatttctctacatcatctccagcacctgttgtttcctgactttttaatgatygccattctaactggtgtgagatggtatctsattgtggttttgatttgcatttctcggatggccagtgatgatgagcattttttcatgtgtctgttggctgcataaatgtcttcttttgagaagtgtctgttcatatccttcgyccactttttgatggggttgtttgtttttttcttgtaaatttgtttgagttctttgta

SEQ ID NO: 212 - DNA, 401 bp, Homo sapiens
agtaatgggatggctgggtcaaatgatatttctagttctagatccctgaggaatcgccacactgtcttctacaatggttgaactagtttacygtctcaccaacagtgtaaaagtgttcctatttctctacatcatctccagcacctgttgtttcctgactttttaatgatygccattctaactggtgtgagatggtatctsattgtggttttgatttgcatttctcggatggccagtgatgatgagcattttttcatgtgtctgttggctgcataaatgtcttcttttgagaagtgtctgttcatatccttcgyccactttttgatggggttgtttgtttttttcttgtaaatttgtttgagttctttgtagattttggatattagccctttgtcagataa

SEQ ID NO: 213 - DNA, 401 bp, Homo sapiens
tgttcctatttctctacatcatctccagcacctgttgtttcctgactttttaatgatygccattctaactggtgtgagatggtatctsattgtggttttgatttgcatttctcggatggccagtgatgatgagcattttttcatgtgtctgttggctgcataaatgtcttcttttgagaagtgtctgttcatatccttcgyccactttttgatggggttgtttgtttttttcttgtaaatttgtttgagttctttgtagattttggatattagccctttgtcagataagtagattgcaaaaattttctcccattctgtaggttgtctgttcactctgatggtagtttcttttgccgtgcagaagccctttagtttaattagatctcatttgtcaattttgg

SEQ ID NO: 214 - DNA, 401 bp, Homo sapiens
tgtagattttggatattagccctttgtcagataagtagattgcaaaaattttctcccattctgtaggttgtctgttcactctgatggtagtttcttttgccgtgcagaagccctttagtttaattagatctcatttgtcaattttggcttttgttgccattgcttttggtgttttagacatgaagtccttgaccatgcctrtgtcctgaatggtattgcctaggttttctcctagggtttttatggttttaggtctaacatgtaagtctttaatccatcttgaattaatttttgtgtaaggtataaggaagggatccagtttcagctttctacatatggctagccagttttcccagcaccatttgttaaatagggaattgtttccccatttcttgtttttg

SEQ ID NO: 215 - DNA, 401 bp, Homo sapiens
tttgtgtaaggtataaggaagggatccagtttcagctttctacatatggctagccagttttcccagcaccatttgttaaatagggaattgtttccccatttcttgtttttgtcaggattgtcaaagatcagatggttgtagatgtgtggtattatttctgagggctctgttctgttccattggtgtatatctctgttttgktaccastacyatgctgttttggttactgtagccttgtagtatagtttgaagtcaggtagtgtgatgcctccagctttgttcttttggcttaggattgtcttggcaatgtgagctcttttcagattccatatgaactttaaagtagttttttccaattctgtgaagcaagtcattggtagyttgatggggatgtcattgaa

SEQ ID NO: 216 - DNA, 401 bp, Homo sapiens
taaggtataaggaagggatccagtttcagctttctacatatggctagccagttttcccagcaccatttgttaaatagggaattgtttccccatttcttgtttttgtcaggattgtcaaagatcagatggttgtagatgtgtggtattatttctgagggctctgttctgttccattggtgtatatctctgttttgktaccastacyatgctgttttggttactgtagccttgtagtatagtttgaagtcaggtagtgtgatgcctccagctttgttcttttggcttaggattgtcttggcaatgtgagctcttttcagattccatatgaactttaaagtagttttttccaattctgtgaagcaagtcattggtagyttgatggggatgtcattgaatctata

SEQ ID NO: 217 - DNA, 401 bp, Homo sapiens
gtataaggaagggatccagtttcagctttctacatatggctagccagttttcccagcaccatttgttaaatagggaattgtttccccatttcttgtttttgtcaggattgtcaaagatcagatggttgtagatgtgtggtattatttctgagggctctgttctgttccattggtgtatatctctgttttgktaccastacyatgctgttttggttactgtagccttgtagtatagtttgaagtcaggtagtgtgatgcctccagctttgttcttttggcttaggattgtcttggcaatgtgagctcttttcagattccatatgaactttaaagtagttttttccaattctgtgaagcaagtcattggtagyttgatggggatgtcattgaatctataaatt

SEQ ID NO: 218 - DNA, 401 bp, Homo sapiens
tggtgtatatctctgttttgktaccastacyatgctgttttggttactgtagccttgtagtatagtttgaagtcaggtagtgtgatgcctccagctttgttcttttggcttaggattgtcttggcaatgtgagctcttttcagattccatatgaactttaaagtagttttttccaattctgtgaagcaagtcattggtagyttgatggggatgtcattgaatctataaattaccttgggcagtaaggccattttcatgatattgattcttcctacccatgagcatggaattttcttccattcgtttgtatcctcttttatttcattgagcagtggtttgtagttcttgaagaggtccttcacatcccttgtaaattggattcctaggtattttattctctt

SEQ ID NO: 219 - DNA, 401 bp, Homo sapiens
atatacaatcatgtcatctgcaaacagggacaatttgacttcctcttttcctaactgaataacctttatttctttctcctgcctgttattatgttgaataggagtggtgagggagggcatccctgtgttgtgccagttttcaaagggaatgctttgagtttttgtccattcagtatgatattggctgtgggtttgtcataratagctcttgtttttttgagatacaccccatcaatacctaatttattgaragtttttagcatgaagggctgttgaattttgtcaaagggcttttcttcatctattgagataatcatgtggtttttgtctttggttctgtttgtatgctggattacatttattgatttgcatatgttgaaccatcctcgcatcccaaggat

SEQ ID NO: 220 - DNA, 401 bp, Homo sapiens
ctaactgaataacctttatttctttctcctgcctgttattatgttgaataggagtggtgagggagggcatccctgtgttgtgccagttttcaaagggaatgctttgagtttttgtccattcagtatgatattggctgtgggtttgtcataratagctcttgtttttttgagatacaccccatcaatacctaatttattgaragtttttagcatgaagggctgttgaattttgtcaaagggcttttcttcatctattgagataatcatgtggtttttgtctttggttctgtttgtatgctggattacatttattgatttgcatatgttgaaccatcctcgcatcccaaggatgaagcccaggtgatcatggtggataagctttttgatgtgctgctggatta

SEQ ID NO: 221 - DNA, 401 bp, Homo sapiens
tggacttcttttggttggtaggctattaattattgccttaatttcagagcctgttattgatctattcagggattcaacttcttcctggtttagttttgggagggtgtatgtgtccaggaatttttccatttcttctagattttctagtttatttacatagaagtgtttatagtattctctgatggtagtttgtatttctgygggattggtggtgatatcccctttatcattttttattgagtccatttgattcttctctcttttcttctttattattcttgctagctgtctatcaattttgttgatcttttcaaaaaaccagctgctggattcattgattttttgaagggttttttttgtatctgtatttccttcagttcttctctgatcttagttatttc

SEQ ID NO: 222 - DNA, 401 bp, Homo sapiens
tctttattattcttgctagctgtctatcaattttgttgatcttttcaaaaaaccagctgctggattcattgattttttgaagggttttttttgtatctgtatttccttcagttcttctctgatcttagttatttcttgccgtctgctagcttttgaatgtgtgttctcttgcttctctagttcttttaattgtgatgttasggtgtcaattttagatctttcctgctttctcttgtgggcatttagtgttataaatttccctctacactgctttaaatgtgtcccatttaaaggtgatttggggtggagagttctttagatgtctattaggtccacttggtgcagagctgagttcaactcctggatatccttgttaactttctgtctcgttgatctgtcta

SEQ ID NO: 223 - DNA, 401 bp, Homo sapiens
tttaaaggtgatttggggtggagagttctttagatgtctattaggtccacttggtgcagagctgagttcaactcctggatatccttgttaactttctgtctcgttgatctgtctaatgttgacagtggggtgttaaattctctcattattattgtgtgggagtctaagtctctttgtaggtctctaaggacttgctttatrtatctgggtgctcctgtattgggtgcatatatatttaagatagttagctcttcttgttgaattgatccctttaccattatgtaatgaccttctttgtctcttttgatctttattggtttaaagtctgttttatcagagactaggattgcaacccctgcctttttttgttttccatttgcttggttgatcttcctccatcc

SEQ ID NO: 224 - DNA, 401 bp, Homo sapiens
tagcatcagtggtctttacaatttgtcatgtttttgcagtcgctggtaccagttgttcctttccatgtttagtgcttccttcaggagctcttttagggcaggcctggtggtgacaaaatctctcagcatttgcttctctgtaaagaattctgtttctccttcacttatgaagcttagtttggctggatatgaaattctggkttgaaaattcttttctttaagaatgttgaatattggccccactctcttctggcttctagagtttctgccaagagatctactgttagtctgaagggtttccctttgtgggcaacccgacctttctctctggctgcccttaacattttttccttcatttcaactttggtgaatctgacaattacgtttcttggagttgctct

SEQ ID NO: 225 - DNA, 401 bp, Homo sapiens
gccaagagatctactgttagtctgaagggtttccctttgtgggcaacccgacctttctctctggctgcccttaacattttttccttcatttcaactttggtgaatctgacaattacgtttcttggagttgctcttctcaaggagtatctttgtggcgttctctgtatttcctgaatttgaatgttggcctgccttgctagkttggggaagttctcctggataataccctgcagagtgttttccaacttggttccattctccccatcactttcaggtacaccaatcagatgtagatttggtcttttcacatagtcccatatttcttgaaggctttgtttgtttctttttactcttttttctctagacttctcttctcacttcatttcattcatttgatcctc

SEQ ID NO: 226 - DNA, 401 bp, Homo sapiens
cagttgatcgaatcagctactgaagcttgtgcattcattacatagttctcatgccatgtttttcagctccatcacgtcatttaaggactcctctacattggttattctagttagccattcgtctaatcttttttcaaggtttttagctttttttgcaatgcgttctaacttcctcctttagcttggagaagtttgatcttytgaagccttcttctttcaactcgtcaaagtcattctccatccagctttgttccattgctggtgaggaactgtgttcctttggagagggagaggcgctctgatttttagaattttcagcgtttctgctctgttttttccccatctttgtggttttatctacctttggtctttgatgatggtgacgtacagatggggttttg

SEQ ID NO: 227 - DNA, 401 bp, Homo sapiens
tggtgacgtacagatggggttttggtgtggatgtcctttctgtttcttagttttccttctaacagttagggtcctcagctgcaggtctgttggagtttactggaggtccactccagaccctgtttgcctggatatcagcagtggaggctgcagaacagtgaatattgctgaacagcaaatgttgctgcttgattgttcctytggaagcttcatctcagaggggtacctggctgtgtgaggtgtcagtctgcccctactggggagtgtctcccagttaggctactcagggttcagggacccacttgaggaggcagtctgtctgttctcagatctcaaactccattctgggagaaccactactctcttcaaagctgtcagacagggacatttaagtctgcaga

SEQ ID NO: 228 - DNA, 401 bp, Homo sapiens
actcagggttcagggacccacttgaggaggcagtctgtctgttctcagatctcaaactccattctgggagaaccactactctcttcaaagctgtcagacagggacatttaagtctgcagaggtttctgctgccttttgtttggctgtgccctgcccccagaggtggcatctacagaggcaggcaggcctccttgagctgcrgtgagctccacccagttcgagcttcctggctgctttgtttacctgctcaagcctcagcaatggtgggcgccccacccccagcctcactgyagccttgcagtttgatctcagactgctgtgctagcaatgaagggggctccgtgggcatgggaccctctgagccatgtgtgggatataatctcctggtgtgccgtttgcta

SEQ ID NO: 229 - DNA, 400 bp, Homo sapiens
ctgtcagacagggacatttaagtctgcagaggtttctgctgccttttgtttggctgtgccctgcccccagaggtggcatctacagaggcaggcaggcctccttgagctgcrgtgagctccacccagttcgagcttcctggctgctttgtttacctgctcaagcctcagcaatggtgggcgccccacccccagcctcactgyagccttgcagtttgatctcagactgctgtgctagcaatgaagggggctccgtgggcatgggaccctctgagccatgtgtgggatataatctcctggtgtgccgtttgctaagaccgttggaaaagggcaatattagtgagaggtgacagcatgctggcagccctcacagccctcgctygctctcagcacctcctctgcc

SEQ ID NO: 230 - DNA, 401 bp, Homo sapiens
cgccccacccccagcctcactgyagccttgcagtttgatctcagactgctgtgctagcaatgaagggggctccgtgggcatgggaccctctgagccatgtgtgggatataatctcctggtgtgccgtttgctaagaccgttggaaaagggcaatattagtgagaggtgacagcatgctggcagccctcacagccctcgctygctctcagcacctcctctgcckgggctcccactttggcagcacttgaggagcccttcagcccaccgctgcactgtgggagcccctttctgggctggccaaggctggagccggctccctcagcttgcagggaggtgtggaaggagaggtgcgagcggcaaccagggctgcacagggtgcttacgggccagctggagttctg

SEQ ID NO: 231 - DNA, 401 bp, Homo sapiens
yagccttgcagtttgatctcagactgctgtgctagcaatgaagggggctccgtgggcatgggaccctctgagccatgtgtgggatataatctcctggtgtgccgtttgctaagaccgttggaaaagggcaatattagtgagaggtgacagcatgctggcagccctcacagccctcgctygctctcagcacctcctctgcckgggctcccactttggcagcacttgaggagcccttcagcccaccgctgcactgtgggagcccctttctgggctggccaaggctggagccggctccctcagcttgcagggaggtgtggaaggagaggtgcgagcggcaaccagggctgcacagggtgcttacgggccagctggagttctgggtgggcatgggcttggtgggc

SEQ ID NO: 232 - DNA, 401 bp, Homo sapiens
ccctgccagagggccctctcagagtggccacctggccctgccagccctggggaatgaggagcttagcacccggaccagcggctgcgcagggtgtgctgggtcccccagcagtgccagcccaccagtgctgtgctcgatttctctccaggccttagctgccttcctgtggggcagggctcgggacctgcagcccgccatgcytgagtcccgcccccacccccacgggstcctgtgcagcctgagcctccccgacgagcgctgcccactgctccatggtgcccagtcccatcgaccacccaagggctgaggagtgtgggcgcacagcacaggactggcaggcagctccaccagcagccccagtgcgagatccactgggtgaggccagctgggctcctgtgtct

SEQ ID NO: 233 - DNA, 401 bp, Homo sapiens
gccacctggccctgccagccctggggaatgaggagcttagcacccggaccagcggctgcgcagggtgtgctgggtcccccagcagtgccagcccaccagtgctgtgctcgatttctctccaggccttagctgccttcctgtggggcagggctcgggacctgcagcccgccatgcytgagtcccgcccccacccccacgggstcctgtgcagcctgagcctccccgacgagcgctgcccactgctccatggtgcccagtcccatcgaccacccaagggctgaggagtgtgggcgcacagcacaggactggcaggcagctccaccagcagccccagtgcgagatccactgggtgaggccagctgggctcctgtgtctagtgggaacttggaraacctttatgt

SEQ ID NO: 234 - DNA, 401 bp, Homo sapiens
acccccacgggstcctgtgcagcctgagcctccccgacgagcgctgcccactgctccatggtgcccagtcccatcgaccacccaagggctgaggagtgtgggcgcacagcacaggactggcaggcagctccaccagcagccccagtgcgagatccactgggtgaggccagctgggctcctgtgtctagtgggaacttggaraacctttatgtctagctaagggattgtaaatacaccaatcagcactctgtctctagctcaaggtttgtaaacacaccaatcagcaccctgtgtctagctcaggttttgtgaatacaccaatcgacactctgtgtctagctactctggtggggacttggaaaacttttatgtctagctaagagattgtaaataacaccaat

SEQ ID NO: 235 - DNA, 401 bp, Homo sapiens
caccaatcgacactctgtatctagctactctggtggggacttggagaacctttgtgtccagctcagggattttaaacacaccaatcagcaccctgtcaaaacagaccactcggctctctgtaaaatggaccaatcagcaggatgtgggtggggccagataagagaataaaagcaggctgcccgagccagcagtggcaaccrgctggggtccccttccacactgtggaarctttgttctttcgctctttgaaataaatcttgctgctgctcaatctttgggtacacactgcctttatgagctgtaacactcactgtgaaggtctgcagcttcactcctgaagccagcaagaccatgaacccaccgggaggaatgaacaactccagacgcgccaccttaagac

SEQ ID NO: 236 - DNA, 401 bp, Homo sapiens
tctggtggggacttggagaacctttgtgtccagctcagggattttaaacacaccaatcagcaccctgtcaaaacagaccactcggctctctgtaaaatggaccaatcagcaggatgtgggtggggccagataagagaataaaagcaggctgcccgagccagcagtggcaaccrgctggggtccccttccacactgtggaarctttgttctttcgctctttgaaataaatcttgctgctgctcaatctttgggtacacactgcctttatgagctgtaacactcactgtgaaggtctgcagcttcactcctgaagccagcaagaccatgaacccaccgggaggaatgaacaactccagacgcgccaccttaagacccgtaacactcaccgcaaaggtctgcag

SEQ ID NO: 237 - DNA, 401 bp, Homo sapiens
cccgattttccaggtgctgtctgtcacccttttccttggctaggaaagggaattccctgaccccttgtgcttcccgggtgaggcaatgcctcgccctgctttggctcacacttggtgtgctgcacccactgttctgcccccactgactgacgagccccagtgagatgaacccagcaccttagttggaaatgcagaaatcaycygtcttctgcgttgctcacactgggagctgtagactggagctgtttytatttggccatcttggaaccaccttcccaatagtacacatttttaaacaaccagatctcatgagaactcactcactatcatgagaacagcaagggggaaatcagcccccatgatctagtcacctcccaacaggtccctcctccaacattggg

SEQ ID NO: 238 - DNA, 401 bp, Homo sapiens
cgattttccaggtgctgtctgtcacccttttccttggctaggaaagggaattccctgaccccttgtgcttcccgggtgaggcaatgcctcgccctgctttggctcacacttggtgtgctgcacccactgttctgcccccactgactgacgagccccagtgagatgaacccagcaccttagttggaaatgcagaaatcaycygtcttctgcgttgctcacactgggagctgtagactggagctgtttytatttggccatcttggaaccaccttcccaatagtacacatttttaaacaaccagatctcatgagaactcactcactatcatgagaacagcaagggggaaatcagcccccatgatctagtcacctcccaacaggtccctcctccaacattgggga

SEQ ID NO: 239 - DNA, 401 bp, Homo sapiens
ggaattccctgaccccttgtgcttcccgggtgaggcaatgcctcgccctgctttggctcacacttggtgtgctgcacccactgttctgcccccactgactgacgagccccagtgagatgaacccagcaccttagttggaaatgcagaaatcaycygtcttctgcgttgctcacactgggagctgtagactggagctgtttytatttggccatcttggaaccaccttcccaatagtacacatttttaaacaaccagatctcatgagaactcactcactatcatgagaacagcaagggggaaatcagcccccatgatctagtcacctcccaacaggtccctcctccaacattggggattataatttgacatgaaatattggtggggacacaaatccaaaccat

SEQ ID NO: 240 - DNA, 401 bp, Homo sapiens
ttagagtttttattttattaaaggctttaattggtaatactcatttctttttcttttattagcattgattttactttctgtagaaatacagaaagcattttcaaatgctaattttattatgtctgtatctggtagaagattcaaaacattgctccaaaaacacttggcagcaaattccccattcactggcaacctgaaatrtaagtttattgagcatgaatgataattcgttatcagatgtaagtcttggctctaattacaagatgcttgtagtccaacatgtagtctaacaccttatactctgatcaagtataagaaagaggccaatttactagtagaaattgcaacaatgaataggaaaaaaaatgtacgctgcaaagcagagcactgtgagagaagaa

SEQ ID NO: 241 - DNA, 401 bp, Homo sapiens
atagttctgtatagggaagtgtgaatgctgtacatagcatgtgactagcttgcatttaatggggaaaagaatttaactagataattagtatatatcaaatgcaatttatgtgtcagacatcatgctatttatgtattttacacaattattatcaaaatgtaatacattaccaatgactagaaataatagttgaagaataakaatagtttcataaaaagtgtaggataattgaatcagagagagacattcagagaagaaaaacgttatgaaaaattttaagtagtagtttgaaggaagaaaaaagagttttccaaaaagaaaatgtctggaaatataaagyaattcaaaatttgagaagcagaggttttgctttagtaaggagagggtaaatagatatggct

SEQ ID NO: 242 - DNA, 401 bp, Homo sapiens
acacaattattatcaaaatgtaatacattaccaatgactagaaataatagttgaagaataakaatagtttcataaaaagtgtaggataattgaatcagagagagacattcagagaagaaaaacgttatgaaaaattttaagtagtagtttgaaggaagaaaaaagagttttccaaaaagaaaatgtctggaaatataaagyaattcaaaatttgagaagcagaggttttgctttagtaaggagagggtaaatagatatggctggtagagtgtaractgtgaccagagcagcgattctcttggcttataagaggaaactgctgggtaatcccaaagggccttgaattgttgatgaaatgtaagttctttgtggagttaattttggtcaaacattgaccaaaa

SEQ ID NO: 243 - DNA, 401 bp, Homo sapiens
aaaaagtgtaggataattgaatcagagagagacattcagagaagaaaaacgttatgaaaaattttaagtagtagtttgaaggaagaaaaaagagttttccaaaaagaaaatgtctggaaatataaagyaattcaaaatttgagaagcagaggttttgctttagtaaggagagggtaaatagatatggctggtagagtgtaractgtgaccagagcagcgattctcttggcttataagaggaaactgctgggtaatcccaaagggccttgaattgttgatgaaatgtaagttctttgtggagttaattttggtcaaacattgaccaaaatgtttataaatttccttttttcgtggtaaaataaaattgtcttatgattgcttcttgagtgaatttttaagga

SEQ ID NO: 244 - DNA, 401 bp, Homo sapiens
gagtgaatttttaaggatattaaaagttggtattccttaaaagttaaccttttacggttaataaactattgctatagtttattatggtctttgattcatttttctactaggttacttgagactgctacacaacatcaaaaaaattctaatgcacatgggcacaggtttattgtttgaattcccataaaaatttaaaacatsactgaaatggcaaagttgatttaacattaaatgtaacatatcacattaaaaatagaagatactaaagaaaaaatatacaaatattgtagtagatggaggaaaacttctctatgcattratgataaaaattatcaggaagttcagagtagaaggaaaagttttcaacctgaaaaaccatttttactaaaagcctacagcaa

SEQ ID NO: 245 - DNA, 401 bp, Homo sapiens
agactgctacacaacatcaaaaaaattctaatgcacatgggcacaggtttattgtttgaattcccataaaaatttaaaacatsactgaaatggcaaagttgatttaacattaaatgtaacatatcacattaaaaatagaagatactaaagaaaaaatatacaaatattgtagtagatggaggaaaacttctctatgcattratgataaaaattatcaggaagttcagagtagaaggaaaagttttcaacctgaaaaaccatttttactaaaagcctacagcaaacatcatgcttgaagattaaatagtagaaacactccttttaaaatgaaacatgacagacatgcatatgtttttattttttgcttttttctctctttttcttgctctcccagtcttcct

SEQ ID NO: 246 - DNA, 401 bp, Homo sapiens
acaatagcataaaggtccaaattctttccaaattgatatatagtctaatgcaatttaataaaaatcccaaacactaatttttatgagattagacaagctgattctaatatatacatggaagaacaaacggccaagaatagccaacatatgcttaaagaaacaaaatcaaggggcttataataatgctgctataattaagartggatgattatgtagatcaatggaatagaacagaaagttcagaaattgacatgttaatttagggaaattaaatattttgaaaaggtagcattgaatattagtgagcaaataattcttttattaagtcacctggtacaatgattatttatatagaaaatttataattggatctctacttcacatcatatatgaaattcaat

SEQ ID NO: 247 - DNA, 401 bp, Homo sapiens
ttataaaaaagtaacagctttgagatataattcatataccatcatacatttcctttaaaatgtataatttaatggtttttagtatatttacaattatgtaactgatagactctttgtgttccttagctcagctaggtctgagttcttgtcaaatgaccaggaagaattaggcacgtggacaccagagagtgagtggagtarrattaattaagcgaaatgaaaactctcagtggagagtgtatgtggggaagggggtggttcccctacctgaaggtgggaaggccccccaacctgccgccccatgtggctgggtctggggtcttttatggactcagaatggagagtgcatgctgattggtttgtgagtatgcaaaaaaggttaaaacaaagacaccactcag

SEQ ID NO: 248 - DNA, 401 bp, Homo sapiens
tataaaaaagtaacagctttgagatataattcatataccatcatacatttcctttaaaatgtataatttaatggtttttagtatatttacaattatgtaactgatagactctttgtgttccttagctcagctaggtctgagttcttgtcaaatgaccaggaagaattaggcacgtggacaccagagagtgagtggagtarrattaattaagcgaaatgaaaactctcagtggagagtgtatgtggggaagggggtggttcccctacctgaaggtgggaaggccccccaacctgccgccccatgtggctgggtctggggtcttttatggactcagaatggagagtgcatgctgattggtttgtgagtatgcaaaaaaggttaaaacaaagacaccactcaga

SEQ ID NO: 249 - DNA, 401 bp, Homo sapiens
ttgctgaataatattccattgtatggatataacacgtttcttttccattcatcacttgatatttaatggtttccactttttgtctgttaggaacagtgctgtaatatacattcatgtaccaagtttttatgtggacatatattaataatttcatttctgctgggtatgtaactaggagtagaattgctgcatcataaagtwattctatatttaatctgagggactgttagacctgttttccagagtgatgatacyattttatattcccacaagtgtccycatggatacttgttattatctgtttcttaaattatggccatcctagtagatgtgaagtggtatctcattgtgattttctttggcatttctctagtgtctaaggatgatgagaaagttttcat

SEQ ID NO: 250 - DNA, 401 bp, Homo sapiens
cttgatatttaatggtttccactttttgtctgttaggaacagtgctgtaatatacattcatgtaccaagtttttatgtggacatatattaataatttcatttctgctgggtatgtaactaggagtagaattgctgcatcataaagtwattctatatttaatctgagggactgttagacctgttttccagagtgatgatacyattttatattcccacaagtgtccycatggatacttgttattatctgtttcttaaattatggccatcctagtagatgtgaagtggtatctcattgtgattttctttggcatttctctagtgtctaaggatgatgagaaagttttcatgagtttaatggccatttgaatattgtctttggtgaaatatacattggttttaaa

SEQ ID NO: 251 - DNA, 401 bp, Homo sapiens
tttgtctgttaggaacagtgctgtaatatacattcatgtaccaagtttttatgtggacatatattaataatttcatttctgctgggtatgtaactaggagtagaattgctgcatcataaagtwattctatatttaatctgagggactgttagacctgttttccagagtgatgatacyattttatattcccacaagtgtccycatggatacttgttattatctgtttcttaaattatggccatcctagtagatgtgaagtggtatctcattgtgattttctttggcatttctctagtgtctaaggatgatgagaaagttttcatgagtttaatggccatttgaatattgtctttggtgaaatatacattggttttaaataaacattgcttcataataacaca

SEQ ID NO: 252 - DNA, 401 bp, Homo sapiens
aagtggtatctcattgtgattttctttggcatttctctagtgtctaaggatgatgagaaagttttcatgagtttaatggccatttgaatattgtctttggtgaaatatacattggttttaaataaacattgcttcataataacacaactttaaagataaacagaatgaggagaaaatagaaaaaaagttaatgtagataaytctttagataagctttgctgtgaatagaagcagtgaaaggagataattcaaaggacatgtgagttgaagaaaggcttgcaaatgttccggttcagcaatttcttttatgccacagtgataatagtagcccacagtcacagtctcagtgggcacagagtgagggaggcaaagtgagggacagaaatggggaaggaagagga

SEQ ID NO: 253 - DNA, 401 bp, Homo sapiens
gggcagaagaaaagcactcaggccattggataggcagactttttcccttgagaatccatgactcttgtcaccctttgcttccctctctacccagggactttactgctttacaacctaaggaaccagctaaaacaacagcaacaacgataacaacaaacccaattctcacccgccgcacctgcccccaccacccgcaaaaarcaaatccaaacaaaaaactatttaaaaatcacacaattcacaaaaagcgtctcaagagtatgttaatgtaaataccatttgtattaaacccttaccttatttaaacgtacacatagrgcttgactttaagaaacccatgcatgaattatttgaataactgaactaatgaagggtgaaattaaaataaatatattcaaata

SEQ ID NO: 254 - DNA, 401 bp, Homo sapiens
aggaaccagctaaaacaacagcaacaacgataacaacaaacccaattctcacccgccgcacctgcccccaccacccgcaaaaarcaaatccaaacaaaaaactatttaaaaatcacacaattcacaaaaagcgtctcaagagtatgttaatgtaaataccatttgtattaaacccttaccttatttaaacgtacacatagrgcttgactttaagaaacccatgcatgaattatttgaataactgaactaatgaagggtgaaattaaaataaatatattcaaataatgagaggyggtataagtgaagggaaatatggtttaaattctgagtcttataaaaataatatgtatgtacatgtagtacaactattaaaatttgggctattcttgtttcttaatatt

SEQ ID NO: 255 - DNA, 401 bp, Homo sapiens
aacaaaaaactatttaaaaatcacacaattcacaaaaagcgtctcaagagtatgttaatgtaaataccatttgtattaaacccttaccttatttaaacgtacacatagrgcttgactttaagaaacccatgcatgaattatttgaataactgaactaatgaagggtgaaattaaaataaatatattcaaataatgagaggyggtataagtgaagggaaatatggtttaaattctgagtcttataaaaataatatgtatgtacatgtagtacaactattaaaatttgggctattcttgtttcttaatatttttgtgtataatgataaaaaacaataaaagaaataaagctatttgatttggatgtacagagaaaaatccaagctatgggaagtacattgtga

SEQ ID NO: 256 - DNA, 401 bp, Homo sapiens
agctattgccttaattttagccccacccatgtacactctgtgacgctgcctgggattctacaaatcacatttatcttttgccactaagctccctgttaggatctgccaatcagaggacgctaggggcggactggaaggctgagtggggaagaaggaagacacttcctgtttgcttcctgttctgtttaacgacaccctaasgattacttttcatttcagcagttatagtttgtttcagtagcaacagttatttccagttttagttttgacagcattcctagaactagctccttagggttttttaaagacaccaacgccaaccagcaagcgccccctactgagcggtctaggtcccagctctgagaagccactcaagtttctaagtttagtatttatattat

SEQ ID NO: 257 - DNA, 401 bp, Homo sapiens
atatgtatatatagatatgtgtctctatatcaatgtatgtattatagatatatacatatatgtatatatagaaccatagataattctccttaatatgcatgtacatagatatgtacatccatattatatgatatagaatatataaatataatatctaatatatgcatattaaggagaattatctatggttctaaatatgcrttatacatatctatatgcatactgtatatcatataatacatatccatgtacatgcatattaaggagaactatttacggtttttggtctcatttgtaatgctcataaaaattttctcttttaattttaatttcattgaaaccatccttggactcatacttggagacaaacttacttggtcactatatattattattttgac

SEQ ID NO: 258 - DNA, 401 bp, Homo sapiens
aataatttgtataaattggaattatttgtttcttaaaggtttatggaacatctaaagaacaaattcatctggctctcatacagtttttaggatactactttgattgacatttcagtttcttttagatctatatcttctatttttcttgaggctattttgataattatttcttaagatattatcaattttcatctagataawaaaatatatcattttatgtatttttaaattcatcgatatttccacttttcattgacaacattattaagttttattgtgtctcttttttcaaattatacttgatgaaattttgaaaatgattggtctttccaaaaatcacctttaggttttattgataaactttttcttattttctaagtcaggatacaaaatcagtgtac

SEQ ID NO: 259 - DNA, 401 bp, Homo sapiens
aaaaactactttaaagttcatatggaaccaaaaaagagcccgcatcaccaaggcaatcctaagccaaaagaacaaagctggaggcatcacactacctgacttcaaactatactacaaggctgtagtaaccaaaacagcatggtactggtaccaaaacagagatatagaccaatggaacagaacagagccctcagaaataaygccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataa

SEQ ID NO: 260 - DNA, 401 bp, Homo sapiens
tggatcccttccttacaccttatacaaaaatcaattcaagatggattaaagacttaaacgttagacctaaaaccataaaaaccctagaagaaaacctaggcatcaccattcaggacataggcatgggcaaggacttcatgtccaaaacaccaaaaggaatggcaacaaaagccaaaattgaccactgggatctaattaaaytaaagagctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaamaaacaaccccatcaaaaagtgggcgaaggacatgaacagacacctatcaaaagaa

SEQ ID NO: 261 - DNA, 401 bp, Homo sapiens
aacaccaaaaggaatggcaacaaaagccaaaattgaccactgggatctaattaaaytaaagagctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaamaaacaaccccatcaaaaagtgggcgaaggacatgaacagacacctatcaaaagaagacatttatgcagccaaaaaacacatgaaaaaatgctcatcatcactggccatccgagaaatgcaaatcaaaaccacaatcagataccatctcacaccagttagaatggcaatcattaaaaagtcaggaaacaacaggtgctgga

SEQ ID NO: 262 - DNA, 401 bp, Homo sapiens
ttcttttaaaaaatcttcaataattctaccctaattttctgagcattttcttagccatctgaaagcttagttcaacaattttcaatgttttgttttttaatactaccttggcataacactgagggtatatccttattttctcattctcacactctcaatagttctatgtagtttgtaattttcattttgctgttcccttgwcctaaaagtaattttgaatgcgaagagcacttttcagtcacttaatttttaaaataaattttattgtgtacatttaaagtatacagcattatgttatggaatacacataggtagtaaaaatttattatggtgaagaaaattaacatatacataatctcatataggaagaaaaaactttgtgtgtggaaagagcagctaaa

SEQ ID NO: 263 - DNA, 401 bp, Homo sapiens
ttttttttatttacttttaatttttgtgggtatacagtaagtgtatatatttatggggtacatgaggtgttttcatacaggcatgtaatatcaaataagcacatcgtggagaatgggatatccaccccctcaagcatttattcttggagttacaaacaatccatttctattctttcagttattttaaaatgtacaaataarttgttattgattatagtctccctgttrtgctatctactaattaatagtagttcttattcataccttctattwttttttgtgcccattaaacatccctacctcccccaccaccaacatcccactatccttcctggcttctggtaaccatccttctactctctctgtccatgagtttaatagttttaatttttagatcccac

SEQ ID NO: 264 - DNA, 401 bp, Homo sapiens
gggtatacagtaagtgtatatatttatggggtacatgaggtgttttcatacaggcatgtaatatcaaataagcacatcgtggagaatgggatatccaccccctcaagcatttattcttggagttacaaacaatccatttctattctttcagttattttaaaatgtacaaataarttgttattgattatagtctccctgttrtgctatctactaattaatagtagttcttattcataccttctattwttttttgtgcccattaaacatccctacctcccccaccaccaacatcccactatccttcctggcttctggtaaccatccttctactctctctgtccatgagtttaatagttttaatttttagatcccacaataagtgagaacatgtgatgtttgtc

SEQ ID NO: 265 - DNA, 401 bp, Homo sapiens
tcatacaggcatgtaatatcaaataagcacatcgtggagaatgggatatccaccccctcaagcatttattcttggagttacaaacaatccatttctattctttcagttattttaaaatgtacaaataarttgttattgattatagtctccctgttrtgctatctactaattaatagtagttcttattcataccttctattwttttttgtgcccattaaacatccctacctcccccaccaccaacatcccactatccttcctggcttctggtaaccatccttctactctctctgtccatgagtttaatagttttaatttttagatcccacaataagtgagaacatgtgatgtttgtctttctgtgcctagttcatttcactccacatgatctccagttccat

SEQ ID NO: 266 - DNA, 401 bp, Homo sapiens
ccactgaaaagtctgctgctaggcatattggctctccattgtatgttatttgtttcatttttcttgctgcttttaggatccctgctttatccttgatctctggcagattgattattaaatacttgccattttgagtctattttctagatcctgtaggtgtgcttcattgttttttattatttttatttttttttctcttgyctcctctgtgtatcaaatagcttgtcttcaggctcacacgttctttcttttggttgattaattttgctattaaagkactctgctgtatttttcattatgccaattgcatttttcagcttcagaatttctgcttgattctttttaattatttcaatctctgttaaatttatctgataagattctgaattccttctctgtgt

SEQ ID NO: 267 - DNA, 401 bp, Homo sapiens
gatccctgctttatccttgatctctggcagattgattattaaatacttgccattttgagtctattttctagatcctgtaggtgtgcttcattgttttttattatttttatttttttttctcttgyctcctctgtgtatcaaatagcttgtcttcaggctcacacgttctttcttttggttgattaattttgctattaaagkactctgctgtatttttcattatgccaattgcatttttcagcttcagaatttctgcttgattctttttaattatttcaatctctgttaaatttatctgataagattctgaattccttctctgtgttatcttgagtttctttgagtttccataacacagcggttttgaattccttgtctgaaatttcacatatctctgtttc

SEQ ID NO: 268 - DNA, 401 bp, Homo sapiens
tattgtagtcttcactgtctaggcttatttgtagccatcctttttgaaaggacttgggtgttgtgatctaagctatatctgctttagcagcaccccaagcccagtaatgctgtggttcttgcagacttgtaaaggatcaccttgatggacttagacaagatccaggagaattttctggattactaggtagagactcttgtyctcttcccttactttctcccaaacaaacagaatctctttctgttctgagtcacctaaagctgggggtggagtgacacaaacacccctgtgaccacctccagtatgactgtgctgagtcagaactgaagccagcacagcactgggtctgcggtaaccactccctggctaatgcctatgttcatataaggccctgaggctct

SEQ ID NO: 269 - DNA, 401 bp, Homo sapiens
tttttcagggacgaaaagctcttcagttagcagaagatgaatgctgccaggattggatcctttctctcaaggttatgggttcttttatgacccaaggtgtgtctaaaatgttcatgtgggaggtagggcccagaacaggggccttttgactctgaccactgccctatcctgctatggctgagctggtatccaagatccaakacaaagtcctcccaacttttccctctcctcttctgaagtggaagaaagggatttcttttcgagctgtgagctgtgaagcctgggggtaggggaggggtgatgccggcactcctttatccacctcagctggtgtctcagtatgtcatgtgccccccccccccccccccagtccactgtttcaggacctggttcagcactgg

SEQ ID NO: 270 - DNA, 401 bp, Homo sapiens
ctggttcagcactgggactcacctaattgttgcagaccttatggactacattggctttcaagtttgtttggagacacagagcactttggtcactggtagtgaggtttgcaggaactcaagttctgacctctgggatccatgatccctctctgagtagtgccggtttaaatgcttccctcgtgggcaggtgtcagctgagtytggtccggtttccctttctgctccacctggatagcacaaaatttaatgtctcacagttgctatgttctctctcctctagcacccagagatgctctctgcaccatgccatgacttccagggggtggagaacaggtaatgtcaggggttcagggctcttttttctatctcttcagttgcctctttcagtgatatgaagttaa

SEQ ID NO: 271 - DNA, 401 bp, Homo sapiens
acaggtaatgtcaggggttcagggctcttttttctatctcttcagttgcctctttcagtgatatgaagttaaaaccaggtactatgagtgctcatctgatttttggttcttatgaagctgtttttttttttttttttttctgtgtagatagttgttaaattggtatctttgtggagaaggcaatcagtggagccttctgtkcggccatcttgctccttatacctgctactttgtattctctgatctatgtctcttcatttctccactcctctgttccaaccacccctggtaaccatgtttgtcttctctatttctgtatatttatttacttattttagaatctacttataaatgagatcatgcagtatttttctttctgtgtctggtttatttcacttgtc

SEQ ID NO: 272 - DNA, 401 bp, Homo sapiens
caagatctcattcttttttaaggctgaagaatatcccattgtatatatgtactacagtttctttatccattcatccatcaatggccacttaggttaggttgtttccatatcttggctattgtagaaaatactgcaatgaatatggaagtgggttatctttatgaggtgttgatttcatttcctttgggtatgcccagaagmgatattactgggacatgtgggagttctatttttaacttctttagaaaccaccatactcttttctataatggccacaccaatgtacattcccactaacagtgtatacaagttcccttttcttcatactcttactgacatttgttatcttcagttacttaatttttattggtgggaagggggctttattaacatttttttgt

SEQ ID NO: 273 - DNA, 401 bp, Homo sapiens
gtctaatccaccgttggtgggcacctaggttgattccacttctttgctattgtgaatagtgctgcaatgaacatatgactacatgtgtcttttgggtagaataatttattttcttttggatatatacccagtaatgggaatgttgggttgactggtagttctgttttaagttctttgagaaatctccaaactgctttccayggtgggtgaactaatttacattcctaccaacagggtataacattcccttttctcaacagcctcaccagcctttgttgtttttgacttttcaataatggtcataatgactggtgtgagatggtatctcattgtggttttgatttcatttatttgatgattattgatggtgagcatatttttatgtttgttggctgcttgta

SEQ ID NO: 274 - DNA, 401 bp, Homo sapiens
cattgaatctacagtttgggcagtattgccatttgaatgacagtgattcttctaatacataagcatgaaatgttttttcatttgtttgtgtcatccatgatttctttcagcagtgttttgtagttctctttgtagagatcttttacctccttggttagaggtattcgtaggtatttcatggtttttgcagcagttgtaaaygggattgctttcttggttttgctctcagtttgagtgttattagtatgtggaaatgaaactgatttttgtacattgattttgtatcctgaaactttattgaaattgtttattttatatatatatatattattatactttaagttctagggtacatgtgcacaacgtgcaggtttgttacatatgtatacatgtgccatgtt

SEQ ID NO: 275 - DNA, 401 bp, Homo sapiens
gagtgttattagtatgtggaaatgaaactgatttttgtacattgattttgtatcctgaaactttattgaaattgtttattttatatatatatatattattatactttaagttctagggtacatgtgcacaacgtgcaggtttgttacatatgtatacatgtgccatgttggtgtgctgcacccattaacttgtcatttatwttaggtatatcccctaatgctgtccctccccacttccccaccccacaacaggctccagtgtgtgatgttccccttcctgtgtccaagtgttctcattgttcaattcccacctawgagtgagaatatgcggtgtttggttttttatccttgcgatagtttgctgagaatgatggtttccagcttcgtccaagtccctacaa

SEQ ID NO: 276 - DNA, 401 bp, Homo sapiens
agggtacatgtgcacaacgtgcaggtttgttacatatgtatacatgtgccatgttggtgtgctgcacccattaacttgtcatttatwttaggtatatcccctaatgctgtccctccccacttccccaccccacaacaggctccagtgtgtgatgttccccttcctgtgtccaagtgttctcattgttcaattcccacctawgagtgagaatatgcggtgtttggttttttatccttgcgatagtttgctgagaatgatggtttccagcttcgtccaagtccctacaaaggacatgaactcatcatttttcacggctgcatagtattccatagtgtatatgtgccacgttttcttaatccagtctatcattgatggacatttgggttggttccaagtctttg

SEQ ID NO: 277 - DNA, 401 bp, Homo sapiens
tatttctagttctagatccctgaggaatcaccacactgtcttccacaatggttgaactagtttacagtcccaccaacaatgtaaaagtgttcctatttctccacatcctctccagcacctgttgtttcctgactttttaatgatcgccattctaactggtgtgagatggtatctcattgtggttttgatttgcatttctcrgatggccagtgatgatgagcattttttcatgtgtctgttggctgcataaaggtcttcttttgagaagtatctgttcatatcctttgcccacttgttgatagggctgtttttttcttgtaaatttgtttgagttctttgcagattctggatattagctctttgtcagatgagtagattgcaaaaattttctcccattctgt

SEQ ID NO: 278 - DNA, 401 bp, Homo sapiens
gtcaggattgtcaaagatcagatggttgtagatgtgtggtattatttctgagggctctgttctgttccattggtctatatctctgttttgttaccactacctgctgttttggttactgtagccttgtagtatagtttgaagtcagataacatgatgtctccagctttgttctttttgtttaggattgtcttggcaatgtgrgcccttttttggttccatatgaacttgaaagtagttttttacaattctgtgaagcaagtcattggtagcttgatagggatggcactgaatctataaattaccttgggcagtatggccattttcatgatatcgattcttcctatccatgagcatggaatgttcttccatttgtttgtatcctcttttatttcattgagcag

SEQ ID NO: 279 - DNA, 401 bp, Homo sapiens
tcatgatatcgattcttcctatccatgagcatggaatgttcttccatttgtttgtatcctcttttatttcattgagcagtggtttgtagttctccttgaagaggtccttcacatctcttataagttggattcctaggtattttattctctttgaagcaattgtgaatgggagttcactcatgatttggctctctgtttgtstgttattggtgtataggaatgcttgtgatttttgtacatttattttatgtcctgagactttgctgaagttgcttatcagcttagggagattttgggctgagacgatggggttttctaaatatacaatcatgtcatctgcaarcagggacaatttgacttcctcatttcctaattgaataccctttatttctttctcctgc

SEQ ID NO: 280 - DNA, 401 bp, Homo sapiens
tattctctttgaagcaattgtgaatgggagttcactcatgatttggctctctgtttgtstgttattggtgtataggaatgcttgtgatttttgtacatttattttatgtcctgagactttgctgaagttgcttatcagcttagggagattttgggctgagacgatggggttttctaaatatacaatcatgtcatctgcaarcagggacaatttgacttcctcatttcctaattgaataccctttatttctttctcctgcctgattgtctctgaagatagaccaatagcaggctctgaaattgaggtaataattaatagcttacctaccaaaaawagtccaggaccagatggattcacagccaaattctaccagaggtacaaggaggagctggtaccattcc

SEQ ID NO: 281 - DNA, 401 bp, Homo sapiens
atcagcttagggagattttgggctgagacgatggggttttctaaatatacaatcatgtcatctgcaarcagggacaatttgacttcctcatttcctaattgaataccctttatttctttctcctgcctgattgtctctgaagatagaccaatagcaggctctgaaattgaggtaataattaatagcttacctaccaaaaawagtccaggaccagatggattcacagccaaattctaccagaggtacaaggaggagctggtaccattccttctgaaactcttccaatcaatagaaaaagagggaatcctccctaactcatttcatgaggccagtgtcatcctgataccaaagactggcagagacacaacaaaaaaagagaattttagaccaatatccctgat

SEQ ID NO: 282 - DNA, 401 bp, Homo sapiens
ggaccagatggattcacagccaaattctaccagaggtacaaggaggagctggtaccattccttctgaaactcttccaatcaatagaaaaagagggaatcctccctaactcatttcatgaggccagtgtcatcctgataccaaagactggcagagacacaacaaaaaaagagaattttagaccaatatccctgatgaacatmggtgcaaaaatcctcagtaaaatactggcaaaccgaatccagcagcacatcaaaaagcttatccaccgtgatcaagtgtgtttcatccctgggatgcaaggctggttcaacatacacaaatcaataaatgtaatccagcatataaacagaactaaagacaaaaaccacatgattatctcaatagatgcagaaaacacctt

SEQ ID NO: 283 - DNA, 401 bp, Homo sapiens
taaaatactggcaaaccgaatccagcagcacatcaaaaagcttatccaccgtgatcaagtgtgtttcatccctgggatgcaaggctggttcaacatacacaaatcaataaatgtaatccagcatataaacagaactaaagacaaaaaccacatgattatctcaatagatgcagaaaacacctttgagaaaattcaacagcycttcatgctaaaaactctcaataaattaggtattgatgggacatatctcaaaataataagagctatttgtgataaacccacagccaatattatactgaattggcaaaaactggaagcattccctttgaaaactggcacaagacagggatgccctttctcaccactcctattcaacatagtgttggaagttctggccaggg

SEQ ID NO: 284 - DNA, 401 bp, Homo sapiens
aaactctcaataaattaggtattgatgggacatatctcaaaataataagagctatttgtgataaacccacagccaatattatactgaattggcaaaaactggaagcattccctttgaaaactggcacaagacagggatgccctttctcaccactcctattcaacatagtgttggaagttctggccagggcagtcaggcaaycagaaattggttatttgttccagtagtcttttggaggagtctttatggcttactcagtatagatcatatcatcagcaaagagagataatttgatttttttacctatgtggatgccttttatttctttctcttgcctgattcctctgggaaggacttgcagtactctattgaataggagtggtgagagttggcaaccttgg

SEQ ID NO: 285 - DNA, 401 bp, Homo sapiens
cttggcttgttccagttcttaaagagaatgctccccgtttttgcctgttcactacaatgttggctgtgggtttgtcatagatgtctcttattgttttgatatatgttccttcagtgcctagttttttgagaacttttaccaagaagggatgttggactatattgaaagttttttgcatctattgagatgataatattgttkttgttcttaattctgtatatgtggtgaatcacatttgttgatttgcatatgttgaaccaaatttgtawcccaagamttaagcctacttggtcacggtgaatgaactttttgatgtgctgctggattcaatttgttagtattttgttgaggatttttgtatctatgttcgtcatggatattggcctgtaattttcttttta

SEQ ID NO: 286 - DNA, 401 bp, Homo sapiens
ggtttgtcatagatgtctcttattgttttgatatatgttccttcagtgcctagttttttgagaacttttaccaagaagggatgttggactatattgaaagttttttgcatctattgagatgataatattgttkttgttcttaattctgtatatgtggtgaatcacatttgttgatttgcatatgttgaaccaaatttgtawcccaagamttaagcctacttggtcacggtgaatgaactttttgatgtgctgctggattcaatttgttagtattttgttgaggatttttgtatctatgttcgtcatggatattggcctgtaattttctttttaagttgcgtctttgccaggtttggttattagagtaggctgacttcatagaataagttaaggaagagtcc

SEQ ID NO: 287 - DNA, 401 bp, Homo sapiens
atagatgtctcttattgttttgatatatgttccttcagtgcctagttttttgagaacttttaccaagaagggatgttggactatattgaaagttttttgcatctattgagatgataatattgttkttgttcttaattctgtatatgtggtgaatcacatttgttgatttgcatatgttgaaccaaatttgtawcccaagamttaagcctacttggtcacggtgaatgaactttttgatgtgctgctggattcaatttgttagtattttgttgaggatttttgtatctatgttcgtcatggatattggcctgtaattttctttttaagttgcgtctttgccaggtttggttattagagtaggctgacttcatagaataagttaaggaagagtccctcctcct

SEQ ID NO: 288 - DNA, 401 bp, Homo sapiens
ccctcattgatttcttttatttttctagctttggggttagttttttgtatttctagtgtgatgttagattattaaattgagatatttctaccttcttgatgtaggagttcagcactatacactttcctcttaacactacttttgcagcatcccagagatttttggtatgtcgtctctctgtttttattcctttcaaataayttttttttgatttctacctttattttgttgtttaccccaaactcattcaggataagctgtttaaatcccatgtaatggggttttgagagatctgttggtattaatttctatttttattccactgtggtccaaaaatatggctagtatgatttcagtttttttgaatttagagacttgctttatggctaagcatgtgattg

SEQ ID NO: 289 - DNA, 401 bp, Homo sapiens
cttgatgatctgtgtaaggggatcagtggggtgttgaagtcccctgctattcttgtgaggctgtgtaaatcttttctaggtcaaaaagtacttgttttatgagtctgggtgctcccatgttgggtgcatacatatttagcatagttaagtctttttgttgaattgaaccctttatcattatgtaatgtccttctttgtccytttttactgytgttgatttaaagtctgtttttttctatgagaatagcaaccttagctcttttttgtgttccatttgcatgatagatcttttccaaccctttactttgagcctatgggtgtcattacatgtgagattggtctcttgaagacaacagtcaaatgggtcttgtatctttgtacaaattgccactctgtgcctt

SEQ ID NO: 290 - DNA, 401 bp, Homo sapiens
tgtgtaaggggatcagtggggtgttgaagtcccctgctattcttgtgaggctgtgtaaatcttttctaggtcaaaaagtacttgttttatgagtctgggtgctcccatgttgggtgcatacatatttagcatagttaagtctttttgttgaattgaaccctttatcattatgtaatgtccttctttgtccytttttactgytgttgatttaaagtctgtttttttctatgagaatagcaaccttagctcttttttgtgttccatttgcatgatagatcttttccaaccctttactttgagcctatgggtgtcattacatgtgagattggtctcttgaagacaacagtcaaatgggtcttgtatctttgtacaaattgccactctgtgccttttaagtgagg

SEQ ID NO: 291 - DNA, 401 bp, Homo sapiens
ctatgtacttaagtggtttttttttggtggagcaagtatatttctttcatttctatgtttaaatcttccttgaggatctcttataagggtggtctagtgttaataaatccccttagtgcttggttgtctgaaaaatattttattttttctttgcttatgaattttagtttggcaggatatgaaatcttggttggaatttcktttctttaacaatgctggaaataggcccccaatctgttctggcttataaggtttctgctgagaagtccagtgttagactgacggggttccctttgtgagtgttctgacctttttctctagctgtctttaagatttttgctttagcattgaccttagacagtctggtgacaatctgcctgggtgatgttcatttagtatat

SEQ ID NO: 292 - DNA, 401 bp, Homo sapiens
ccccaatctgttctggcttataaggtttctgctgagaagtccagtgttagactgacggggttccctttgtgagtgttctgacctttttctctagctgtctttaagatttttgctttagcattgaccttagacagtctggtgacaatctgcctgggtgatgttcatttagtatattatgtcacaggcattctctgtatttcytttgcttggatgtctacctgtctaggaagattagataacttttcttgaattattccctcaaatgttttctagattgttttctttgtctctctttctctcaggagtgccaataattcataggtttggtcacttcatataatcccatatttcttgaagaccgtttatttttaaaattcttttttctttacttttgtctgact

SEQ ID NO: 293 - DNA, 401 bp, Homo sapiens
cattacctttttaactccactttttctttttgtattttatttttgttttgctttttttttgttgctcttctcattcctctattcattgcatcctctaataattcttttcagacagcatttccaagtggtaaatgatgtcagtctttttctttctttctgtaatttctatatatttgaaatcctgtatttatctaactcttygtatttaccaggttagataaaactaatctggttaatttttatttctatagtaaaatttttttattataccttaagttctagggtacatgtgcacaaggtgcaggtttgatacataggtrtacatgtgccatgttgctttgcagcacccatcactcatcatttacattaggtatttctcctagtgctatmcctccccagcc

SEQ ID NO: 294 - DNA, 401 bp, Homo sapiens
tccaagtggtaaatgatgtcagtctttttctttctttctgtaatttctatatatttgaaatcctgtatttatctaactcttygtatttaccaggttagataaaactaatctggttaatttttatttctatagtaaaatttttttattataccttaagttctagggtacatgtgcacaaggtgcaggtttgatacataggtrtacatgtgccatgttgctttgcagcacccatcactcatcatttacattaggtatttctcctagtgctatmcctccccagcccccagccccccaacaggcctcactatgtgatgttccctgctctatatccaagtgatctcattgttcaattcccacctatgggtgagaacatgwggtgcttggttttcatccttgtgaca

SEQ ID NO: 295 - DNA, 401 bp, Homo sapiens
atctaactcttygtatttaccaggttagataaaactaatctggttaatttttatttctatagtaaaatttttttattataccttaagttctagggtacatgtgcacaaggtgcaggtttgatacataggtrtacatgtgccatgttgctttgcagcacccatcactcatcatttacattaggtatttctcctagtgctatmcctccccagcccccagccccccaacaggcctcactatgtgatgttccctgctctatatccaagtgatctcattgttcaattcccacctatgggtgagaacatgwggtgcttggttttcatccttgtgacagtttgctcagaatgatggtttccagcrtcatccatgtccctgaaaaggacgtgaactcatccttttttat

SEQ ID NO: 296 - DNA, 401 bp, Homo sapiens
acaaggtgcaggtttgatacataggtrtacatgtgccatgttgctttgcagcacccatcactcatcatttacattaggtatttctcctagtgctatmcctccccagcccccagccccccaacaggcctcactatgtgatgttccctgctctatatccaagtgatctcattgttcaattcccacctatgggtgagaacatgwggtgcttggttttcatccttgtgacagtttgctcagaatgatggtttccagcrtcatccatgtccctgaaaaggacgtgaactcatccttttttatggctgcatagtattccatggtgtatatatgccacattttcttaatccagtctatcattgatggacatttgggttggttacaagtctttggtattgtgaatagtg

SEQ ID NO: 297 - DNA, 401 bp, Homo sapiens
cccatcactcatcatttacattaggtatttctcctagtgctatmcctccccagcccccagccccccaacaggcctcactatgtgatgttccctgctctatatccaagtgatctcattgttcaattcccacctatgggtgagaacatgwggtgcttggttttcatccttgtgacagtttgctcagaatgatggtttccagcrtcatccatgtccctgaaaaggacgtgaactcatccttttttatggctgcatagtattccatggtgtatatatgccacattttcttaatccagtctatcattgatggacatttgggttggttacaagtctttggtattgtgaatagtgctgcaataaacatacatgtacatgtgtctttatagtagcatgacttctaatcc

SEQ ID NO: 298 - DNA, 401 bp, Homo sapiens
tgtgtctgttggctgcatagatgtcttcttttgagaagtgtctgttcatatcctttgctcactttttgatgggcttgtttttttcttataaatttgtttaagttctttgtagattctggatattagccctttgtcagatgggtagattgcaaaaattttttcccattatgtaggttgccggttcactctgatggtagtttyttttgccatgcagaagctctttagtttaattagatcccatttgcctactttggcttttgttgccattgcttttggtattttagtcatgaagtccttgcctatgcctatgtcctgtatggtattacctaggttttcttctagggtatttatagttttaggcctaacattcaagtctttaatccatcttgaattaatttttg

SEQ ID NO: 299 - DNA, 401 bp, Homo sapiens
ccttgcctatgcctatgtcctgtatggtattacctaggttttcttctagggtatttatagttttaggcctaacattcaagtctttaatccatcttgaattaatttttgtataaggtataaggaagggatccagtttcagctttctacatatggctagccagtttttccagcacgatgtattaaatagggaatcatttcccyatttcttgtttttgtcaggtttgtcaaagatcagatggttgtagatgtgtggtattatttctgaggcttctattctgttccatttgtctatatctctgttttggtaccagtaccctgctgttttggttactgtagccttgtagtatagtttgaagtcaggtagtgtgatgcctccagctttgttctttttgcttaggatt

SEQ ID NO: 300 - DNA, 401 bp, Homo sapiens
ttcctaattgaataccctttatttctttctcttgcctgattgccttggctggaacttccaacactatgttgaataggagtggtgagagggggcatccttgtcttgtgccggttttcaaagggaatgcttccagtttttgtccattcggtatgatattggttgtgggtttgtcatagatagctcttattattttgagatacmttccctcaatacctagtttattgagagtttttagcatgaagagctgtcgaattttgttgaaggccttttctgcatctattgagacaatcatgtggtttttgtcatttgttctgttaatgcaatggattatgtttattgatttgtgtatgttgaaccagtcttgcatcccagggaggaatctgacttggtcatggtggata

SEQ ID NO: 301 - DNA, 401 bp, Homo sapiens
gctcctctttgtacctctggtagaattcagctgtgaatccatctggtcctggagtttttttggttggtagcctattaattattacctcaatttcagagcctgttattgatctattcagagattcaacttcttcctggtttagtcttgggagggtgtaggtgtccagaaatgtatccatttcttctagattttctagtttayttgtgtagaggtgtttataatgttctctgatggtagtttgtatttttgtggaatcgatggtgatatcccctttatcrttttttattgtgtctatttgactcttccctgttttcttctttattagtcttgctagctataattttgttgatcttttcaaaaaaccagctcctggattcattgattttttgaagggttttttt

SEQ ID NO: 302 - DNA, 401 bp, Homo sapiens
attattacctcaatttcagagcctgttattgatctattcagagattcaacttcttcctggtttagtcttgggagggtgtaggtgtccagaaatgtatccatttcttctagattttctagtttayttgtgtagaggtgtttataatgttctctgatggtagtttgtatttttgtggaatcgatggtgatatcccctttatcrttttttattgtgtctatttgactcttccctgttttcttctttattagtcttgctagctataattttgttgatcttttcaaaaaaccagctcctggattcattgattttttgaagggtttttttaatgtatctatctctttcagttctgctctsttcttagttatttcttgccttctgctagcttttgaatgtgtttgctc

SEQ ID NO: 303 - DNA, 401 bp, Homo sapiens
atggtagtttgtatttttgtggaatcgatggtgatatcccctttatcrttttttattgtgtctatttgactcttccctgttttcttctttattagtcttgctagctataattttgttgatcttttcaaaaaaccagctcctggattcattgattttttgaagggtttttttaatgtatctatctctttcagttctgctctsttcttagttatttcttgccttctgctagcttttgaatgtgtttgctctggcttctctagttcttttaattgtgatgttagggtgtcgattttaaatctttcctgttttctcttgtgggcatttagtggtataaatttccctgtacacactgctttaaatgtgtcccagagattctggtatgttgtgtccttgttctcatt

SEQ ID NO: 304 - DNA, 401 bp, Homo sapiens
acactgctttaaatgtgtcccagagattctggtatgttgtgtccttgttctcattggtttcaaagaacatctttatttcttccttcatttcgttatttacccagcagttatttaggagcaagttgctcactttccatctagttgtgtggttttgagtgagtttcttaatcctgagttctaatttgattgcactgtggtctraaagacagtttgttgtgattgctgttcttttacatttkctgaggagtgctttacttccaactatgtggtcaattttaraataagtgtgatgtggtgctgagaagaatgtatattccgttgatttggggtggagagttctgtagatgtctattaggtctgcttgttgcagagctgagttcaggtcctggatatccttatta

SEQ ID NO: 305 - DNA, 401 bp, Homo sapiens
gtgtccttgttctcattggtttcaaagaacatctttatttcttccttcatttcgttatttacccagcagttatttaggagcaagttgctcactttccatctagttgtgtggttttgagtgagtttcttaatcctgagttctaatttgattgcactgtggtctraaagacagtttgttgtgattgctgttcttttacatttkctgaggagtgctttacttccaactatgtggtcaattttaraataagtgtgatgtggtgctgagaagaatgtatattccgttgatttggggtggagagttctgtagatgtctattaggtctgcttgttgcagagctgagttcaggtcctggatatccttattaaccttctgtcttgttgatctgtctaatattgacagtgg

SEQ ID NO: 306 - DNA, 401 bp, Homo sapiens
cttccttcatttcgttatttacccagcagttatttaggagcaagttgctcactttccatctagttgtgtggttttgagtgagtttcttaatcctgagttctaatttgattgcactgtggtctraaagacagtttgttgtgattgctgttcttttacatttkctgaggagtgctttacttccaactatgtggtcaattttaraataagtgtgatgtggtgctgagaagaatgtatattccgttgatttggggtggagagttctgtagatgtctattaggtctgcttgttgcagagctgagttcaggtcctggatatccttattaaccttctgtcttgttgatctgtctaatattgacagtggggtgttaaagtstcccattattattgtgtgggagtctaag

SEQ ID NO: 307 - DNA, 401 bp, Homo sapiens
tttacttccaactatgtggtcaattttaraataagtgtgatgtggtgctgagaagaatgtatattccgttgatttggggtggagagttctgtagatgtctattaggtctgcttgttgcagagctgagttcaggtcctggatatccttattaaccttctgtcttgttgatctgtctaatattgacagtggggtgttaaagtstcccattattattgtgtgggagtctaagtctctttgtaggtctctaaggacttgctttatgaatctgggtgctcctgtattgcatgcatatatattaggatagttagctcttcttgttgaattgatccctttaccattatgtaatggccttctttgtctcttttgatctttgttggtttaaagtctgttttatcagagac

SEQ ID NO: 308 - DNA, 401 bp, Homo sapiens
actgatagatgttgactctttattcaatttgccagtctgtgtcttttaattggtacatttagcccatctacatttaaggttaatattgttatgtgtgaattcatcctgtcattatgatgttcgctggttatttcgcccattaattgatgcagtttcttcatgccatcaatggtctttacaatttggcctgtttttgcagtsgctggtaccagttgtttctttccctgtttagtgcttccttcaggagctcttgtaaggcaggcctggttgtgacaaaactctcagcatttgcttgtctgtaaaggattttatttctccttcacttatgaagcttagtttggctggatacaaaattctggtttgaaaattcttttctttaagaatgttgaatattggccccc

SEQ ID NO: 309 - DNA, 401 bp, Homo sapiens
aggattttatttctccttcacttatgaagcttagtttggctggatacaaaattctggtttgaaaattcttttctttaagaatgttgaatattggccccccactctcttctggcttgtaaggtttctgccgagatatctgctgttagtctgatgggcttccctttgtgggtaacctgatctttctctctggctgcccttaamattttttccttcatttcaaccttggtgaatctgacaattatgtgtcttggggttgctcttctcgaggagtatctttgtcgtgttttctgtatttcctgaatttgaatgttggcctgccttgctaggttggggaagttctcctggataatatcctgaagagtattttccaacttggctccattctccccatcactttcagg

SEQ ID NO: 310 - DNA, 401 bp, Homo sapiens
actgatacactttcttccacttgatcgaagcagctgttgaagcttgtgcatgcatcatgaagttcttgtgccgtggttttcagctccatcaggtcatttaaggtcttctcttcactctttattgtagttagctattcatctaatctttcttcaaggtttttagcttccttgcaatgggtttgaacatcctcctttagctcrgagaagtttattaccaaccttctgaaacctacttctgtcaactygtcaaagtcattccccatccagctttgttctgttgctgacgaggagctgtgatcctttgaaggagaagagtcgctctgatttttagaattttcagcttttctgctctggtttctccccatctctgtgtttttatctgcctttggtctttgatgttg

SEQ ID NO: 311 - DNA, 401 bp, Homo sapiens
tgtgcatgcatcatgaagttcttgtgccgtggttttcagctccatcaggtcatttaaggtcttctcttcactctttattgtagttagctattcatctaatctttcttcaaggtttttagcttccttgcaatgggtttgaacatcctcctttagctcrgagaagtttattaccaaccttctgaaacctacttctgtcaactygtcaaagtcattccccatccagctttgttctgttgctgacgaggagctgtgatcctttgaaggagaagagtcgctctgatttttagaattttcagcttttctgctctggtttctccccatctctgtgtttttatctgcctttggtctttgatgttggtgacctatagatggggtttttgtgtagatgactttttgttgat

SEQ ID NO: 312 - DNA, 401 bp, Homo sapiens
tattcctttatgtttgttagttttccttctaacagtcaggtccctcagctgcaggtctgttggattttgctggacatccactccagaccctatttgcctgggtatcaccagcagaggctgcagaatagcaaatattgttacctgatccttcctctggatgctttgtccaagaggggcagccacctatatgaggtgcctgtyggcccctactgggaggtgtcacccagttagtcagggacccacttgaggaggcagtctgtccattctcagagctcaaccaccatgctgggagaaccactgctgtcttcagagctgtcagwcagggatgtttaagtctgtagaagttgtctgctttcttttgttcagctatgccctacccacagaggtggagactagaggca

SEQ ID NO: 313 - DNA, 401 bp, Homo sapiens
gcagaatagcaaatattgttacctgatccttcctctggatgctttgtccaagaggggcagccacctatatgaggtgcctgtyggcccctactgggaggtgtcacccagttagtcagggacccacttgaggaggcagtctgtccattctcagagctcaaccaccatgctgggagaaccactgctgtcttcagagctgtcagwcagggatgtttaagtctgtagaagttgtctgctttcttttgttcagctatgccctacccacagaggtggagactagaggcagtaggccttgttgagctgcagtgggctctgcccagttcaagcttccaggccactttgtttacctactgaagcctcagcaatggcggacacccctcacccagccaggctgtcgyctcaca

SEQ ID NO: 314 - DNA, 401 bp, Homo sapiens
tgtcagwcagggatgtttaagtctgtagaagttgtctgctttcttttgttcagctatgccctacccacagaggtggagactagaggcagtaggccttgttgagctgcagtgggctctgcccagttcaagcttccaggccactttgtttacctactgaagcctcagcaatggcggacacccctcacccagccaggctgtcgyctcacaggttgatctcagactgctgcactagcagggagcaaggctccatgagcatgggagctgccaagctaggcataggagagaatctccttgtctgctggttgctaagaccttaggaaaagcagggtatttgggcggaagtgtcctgtttttccaggtagtctgtctcggcttcccttggctaggaaggggaaatcccc

SEQ ID NO: 315 - DNA, 401 bp, Homo sapiens
aagaatctgtgccctgggctcaccatttctactgggtgttgacagttgcctgaagcacaactttgtctctctgacccagtgttttgccactctcctccacctgaagaagatttttttttttctattgcttggctcttgggcaggttgaggagagaagagaggagatgaaggatgtgtaggttgctcctgctgtaaagatcygccctattttgcctggcccctgtcctatttctagtttctgctaccttcagacatgaggttactggtgcttctcctgtcttttgtagtttcgactctcttaagtgcatttgggctgtggttcccatctccaattcaatcttctgctttctgccttttaaagtcctgacagtatctcctttttttttgttttctgttgttga

SEQ ID NO: 316 - DNA, 401 bp, Homo sapiens
gcagttagcagctacttagggctatagtttttagttatgtttttacagtatatatttccatcctatgttctcttactctagaaaatgtaagataaatctagggctatccctgtataattttagcctcatagaatcttgaaatgaagaataggtgttgaccagttttttagaaacagggtagggggtcttgttctttcatcraggctggagtgcagtggtctaatcatagctcactacagccttgacctcctgggctcaagccatcttcccaccttccaagtagttgggattagagtcatgagccaccatgcttggctccagttttcttatttgtttgccaagtggattgtcttcttttctgttattcaaacaaataaatatgcaaaacagcaaaaaaagtt

SEQ ID NO: 317 - DNA, 401 bp, Homo sapiens
tcaggaaaaaggctgctcatgttgtactaattctggcttctcatttccgtctcttagttctgcttctgtgggagctgccctccctgaaaatgtgtgtttctgtagtggggtacgatccactgacgttcctgaaggaagagcagttctttaggtgcctgacttggtgaggactttgtcattgatgccttaaagcatcaatgrtcatgatgagagccttacgtagtctttcatgaagtcagctccttcacctgtcaccatcccatttttccctccacaggtgtcaygtagggaggagagaaggaaattccttggcatcccctttatcatctttaccatttctttgaccttgtccaaccagtcatatcacaaacaagcaaacaaccaagcaaaacccaaatatt

SEQ ID NO: 318 - DNA, 401 bp, Homo sapiens
ctgaaaatgtgtgtttctgtagtggggtacgatccactgacgttcctgaaggaagagcagttctttaggtgcctgacttggtgaggactttgtcattgatgccttaaagcatcaatgrtcatgatgagagccttacgtagtctttcatgaagtcagctccttcacctgtcaccatcccatttttccctccacaggtgtcaygtagggaggagagaaggaaattccttggcatcccctttatcatctttaccatttctttgaccttgtccaaccagtcatatcacaaacaagcaaacaaccaagcaaaacccaaatattttcttcttttagtcaaaacacgaaaactaatatgaatattaattcatgcaaatgaaaacctgcaatgatcacccacaaaccag

SEQ ID NO: 319 - DNA, 401 bp, Homo sapiens
gtcaaaattggagccacttttcaagacctagctcaggattttgctctgaaacccttcctgatcctcccggtttaatttaatcactccttcctcttcttcttaacagcacttcttatctgtaccggtcctttgaccctgaatcatatgctactttatatggttcattgcatttgcaagcctatttgtctgatcttagctagwttaaaaagsctttgagggcagaggctgtttgtttctgtgcttatactatctagtggctgtatagggggaaaaattacatgttgatgatcccaactaatccttttgctccaggatacgtggcttcctcaggacatgccatgcatatgtgaggtctattttaattcataacatcctagatatggctccagagtcagataaac

SEQ ID NO: 320 - DNA, 401 bp, Homo sapiens
ggagccacttttcaagacctagctcaggattttgctctgaaacccttcctgatcctcccggtttaatttaatcactccttcctcttcttcttaacagcacttcttatctgtaccggtcctttgaccctgaatcatatgctactttatatggttcattgcatttgcaagcctatttgtctgatcttagctagwttaaaaagsctttgagggcagaggctgtttgtttctgtgcttatactatctagtggctgtatagggggaaaaattacatgttgatgatcccaactaatccttttgctccaggatacgtggcttcctcaggacatgccatgcatatgtgaggtctattttaattcataacatcctagatatggctccagagtcagataaacctaaatttg

SEQ ID NO: 321 - DNA, 401 bp, Homo sapiens
tgttttgtttcatgttaatgctttttcttccagcaactgcccaaagcccctcttcctcatgttggggctcagaagctgataccccaatacatggcgctttgacatgttgagttgaaggaaaagcctcaggtctctttgaccttcccctccactcccgatattctgtcttccccaaagcacagggtgaaattgttctctgargttccttgatctgcctaaagtctggaactgccaaagaataaaacaattacctctgttcccttccctgagtttgtattaattgaaatcacttttagggaagaaagattgaagtctgttaacacgcctggacagacttttgtcataaaccattgtcttctgcttcagtcccattcagtattatatagaaccatttaccagcc

SEQ ID NO: 322 - DNA, 401 bp, Homo sapiens
aagtctggaactgccaaagaataaaacaattacctctgttcccttccctgagtttgtattaattgaaatcacttttagggaagaaagattgaagtctgttaacacgcctggacagacttttgtcataaaccattgtcttctgcttcagtcccattcagtattatatagaaccatttaccagccattgtctgctctatgggyccaacagactttgtcccaggccattgtatattcttcaagcccattgaattcccctaaaaataatttactactccccccataaaatcatccatatttcctcatctcacattatcctaagaagaagggtagataaccacttgtaccccactgggtgttggggtgatcactctgtgatttctcccatgcatgttawtaagaat

SEQ ID NO: 323 - DNA, 401 bp, Homo sapiens
ctatgggyccaacagactttgtcccaggccattgtatattcttcaagcccattgaattcccctaaaaataatttactactccccccataaaatcatccatatttcctcatctcacattatcctaagaagaagggtagataaccacttgtaccccactgggtgttggggtgatcactctgtgatttctcccatgcatgttawtaagaatttatatgtcttttctagtattaatctgccttttgttgatttttttgcaaaactttggagggaaaaagggaagtttgcccttcacccctatacttttcttcttgtttgtagagtcactgactcattgttaccattttcttatctccattctcttaccaacccaatgcaatagagtttctcctacaggtcctctg

SEQ ID NO: 324 - DNA, 401 bp, Homo sapiens
gctgaggtgggcagatcacttgaggtcaggagtttgagaccagcctggccaacatggcaaaaccccgtctctactaaaaatacaaaaattatttgggcatggcggcacatacctgtaatcccatctacttgggaggctgaggcaggagaattgcttgaacctgggaggtggaggttgcagtgagccaagatggcgccactrtattccagcctgggtgaaagagtgagtgagactctgacacacacacacacacacacacatacacacacacacacacacaaagtagtaagcactcaggagttcgataaccacctttatgttgatggcttctaaatctctgatatcagtccagatccttttcttgacctcaactacagggccaactaactactagatttctc

SEQ ID NO: 325 - DNA, 401 bp, Homo sapiens
ctagatttctcaaacactattaagacagaactcttcacctctcccaggtctccaaatttattcttcctctcctgttccttctctcagggaatgacaccattatccattctgttgttattcaagtaaaacagactcacatccttcttgacatttcatttttttatatccaattaatcatcaaatttctactcaagcttcctkaccctgttttcctcttctgggtagataggtcttgtttgataattcatctgcaaatatatagactagagtgcttacttaaaaaccgctctcttgtttttcttttcatccacctgttaccacatagcttaatcagttttgccacatccctttcagtgtggacttagaaaatatacccccaaaaagcttcagtttcaattagc

SEQ ID NO: 326 - DNA, 401 bp, Homo sapiens
ctgggtagataggtcttgtttgataattcatctgcaaatatatagactagagtgcttacttaaaaaccgctctcttgtttttcttttcatccacctgttaccacatagcttaatcagttttgccacatccctttcagtgtggacttagaaaatatacccccaaaaagcttcagtttcaattagctgggcgtgatagcacgygcctgtaatcccagctactcgggaggctgaggcatgagaattgcttaagcccagaggtggaggttgcagtgagccaagaatgggccactgcactctagcctgggcgacagagcgagactccgtctcaaaaaaaaaaaaaaaaaaaaagaaatgaatgygcatatgactaccatcctaatataaatggagcttatgccagt

SEQ ID NO: 327 - DNA, 401 bp, Homo sapiens
cccaaaaagcttcagtttcaattagctgggcgtgatagcacgygcctgtaatcccagctactcgggaggctgaggcatgagaattgcttaagcccagaggtggaggttgcagtgagccaagaatgggccactgcactctagcctgggcgacagagcgagactccgtctcaaaaaaaaaaaaaaaaaaaaagaaatgaatgygcatatgactaccatcctaatataaatggagcttatgccagtactatttgcagtagtactacttgaaataatgctcacaataaattttatgcttattaaatagtaattatacataatatagaaagtcaaatagtgctacaaaacttacaataacaacactcattaacttgacccccttccaaatctgatttttttacttc

SEQ ID NO: 328 - DNA, 401 bp, Homo sapiens
cattaacttgacccccttccaaatctgatttttttacttctccaaggcaaccactttcaattcttttagttacactttcaacacttctattgttgtctccttatttctaaattaaatgcttatactgtgacttcttgattttaaactttaggtattatttattgacttcctgttttgagagttttgctttcttataccacwcctccccttgcctttcccccctgattaytcctctctccatcttcctaatagatttacatataatttctatttacgtttagaattttcattaccatgactatggctagagctgagccctgtagtgtactacatataataacatttttgttttactacaaatgcttttgcttttcctggagttaaaatgttcttattttaat

SEQ ID NO: 329 - DNA, 401 bp, Homo sapiens
tttttttacttctccaaggcaaccactttcaattcttttagttacactttcaacacttctattgttgtctccttatttctaaattaaatgcttatactgtgacttcttgattttaaactttaggtattatttattgacttcctgttttgagagttttgctttcttataccacwcctccccttgcctttcccccctgattaytcctctctccatcttcctaatagatttacatataatttctatttacgtttagaattttcattaccatgactatggctagagctgagccctgtagtgtactacatataataacatttttgttttactacaaatgcttttgcttttcctggagttaaaatgttcttattttaatgtgttttcttacatttctttttacctat

SEQ ID NO: 330 - DNA, 401 bp, Homo sapiens
ttactaaatcagtcatatgctttgcacaagcactataaaaatcttctcagtatggtcaggtttttttcttttttcttggcgaattcctcctagaaatctctatctgactactctaatcttaactggttacattctaagcctgctccacagctgttgttttagacacttatattcactcttttttggaaattccctttaccrctctccttggttctttgtaacattactggatttcctgaatactatttcttagattccatcttatttgttagagcacattctccaataatttcctgagaaaggggttaggggaaataatgttttgtagaaacttgcatgtctgaaactatgtattatattgtcacatttgattagctgttttgccagacattgagttttaa

SEQ ID NO: 331 - DNA, 401 bp, Homo sapiens
gtagagactgggtttcacccagtcaggctggtctggaactcctgacctcagctaatccatctgcctcagcatcccaaagtgctgggattacaggagtgagccaccatacccagctgatattacattttaaaaaggagagtctgggtaggcctcattgagaatgtttgatgatgcttgactgctcatcatatttacaaatgmggtatgaaaaagtaattggaagcactttgtaaatgtgtgcatgtgggggatggattgttttgtgaaccattgggccttaccatagattaattgagcatttaaccacttctttgggccctttgccttgaactgactgctttctccaggagaagctttattctcctgtctgaaacatatgtgccagactgccagcattctgr

SEQ ID NO: 332 - DNA, 401 bp, Homo sapiens
mggtatgaaaaagtaattggaagcactttgtaaatgtgtgcatgtgggggatggattgttttgtgaaccattgggccttaccatagattaattgagcatttaaccacttctttgggccctttgccttgaactgactgctttctccaggagaagctttattctcctgtctgaaacatatgtgccagactgccagcattctgragccaagtcactatgtagatcatctctctttttatttgagacaaggtctggctctgtcgcccaggctggagtgcagtggcatgatctcagctcactgcaacctctgcctcccaggccaatgcyatcctcccacctcagattcccaagtagctagggctccagccacgcaccatcatgcccagctaatttttatatttttt

SEQ ID NO: 333 - DNA, 401 bp, Homo sapiens
ccttgaactgactgctttctccaggagaagctttattctcctgtctgaaacatatgtgccagactgccagcattctgragccaagtcactatgtagatcatctctctttttatttgagacaaggtctggctctgtcgcccaggctggagtgcagtggcatgatctcagctcactgcaacctctgcctcccaggccaatgcyatcctcccacctcagattcccaagtagctagggctccagccacgcaccatcatgcccagctaatttttatattttttgcagagacaggatttcaccatgttttccaggctggtctcaaacccgtgagctcaagtgatccacctgccttagcctcccaaagtgctgggattacaggcctgagccaccatgcccagtcaata

SEQ ID NO: 334 - DNA, 401 bp, Homo sapiens
tttggaggaagacaagataaacctgccctatttaataagaagtccaaaataaaagacttaatccaaattacttgaaaacttttctgaatatatgaaataaaattttcattctcacaatgagaatagtctttcattctctatgaattctccaaataatttagtgattaagaaaacagatctattttcttaatatttcataarccttttggttacatactaaaacaatgtattaatattcttatacggtaatcatatttgagttggttcattagactttattttaacattatgagtaatttttttttttattagaaagtcttttgaattgtagggcataaggaatttttagttgtgactcctaggtctaacatttaaaaaaattcaaaacacactgtcttagc

SEQ ID NO: 335 - DNA, 401 bp, Homo sapiens
attttgtaagcctgactccatagaccataaaatattggaaagatcacttgctatgaagtcaataaacttggaatttaatctcaactataccactggctacctgactttaaatgaaatgaacacttttgacctcaagttcctaatctttaaaatggggcttaaactagttggcctaataccaatattgaatgattatttgayagttacatagaaatagattggatgtagaaatagagatatgaattgcatggtgtttgctcactagaatgtggaaaactgtaaaggatgcatgaatatcaagcaaagagaaataagtcacataggttgcctgccattctttaatgcttattttctttcaattttttctttttaataatcttactaaagtgaagctggggctg

SEQ ID NO: 336 - DNA, 401 bp, Homo sapiens
ttggatgtagaaatagagatatgaattgcatggtgtttgctcactagaatgtggaaaactgtaaaggatgcatgaatatcaagcaaagagaaataagtcacataggttgcctgccattctttaatgcttattttctttcaattttttctttttaataatcttactaaagtgaagctggggctgttagtggtggcaaatccrtatgggyctgcagcaaccttacttcttgcctccttagaagaaagaattcaactgaggggcattaggcagagggagaaactgaggaaagttttagagcatgagtgaaagtttatttaaaagctttagagaagtaatgaaattcctttcattacttctcaagccggcgacttgagagatcaagtgcactgtttgccctttga

SEQ ID NO: 337 - DNA, 401 bp, Homo sapiens
tagaaatagagatatgaattgcatggtgtttgctcactagaatgtggaaaactgtaaaggatgcatgaatatcaagcaaagagaaataagtcacataggttgcctgccattctttaatgcttattttctttcaattttttctttttaataatcttactaaagtgaagctggggctgttagtggtggcaaatccrtatgggyctgcagcaaccttacttcttgcctccttagaagaaagaattcaactgaggggcattaggcagagggagaaactgaggaaagttttagagcatgagtgaaagtttatttaaaagctttagagaagtaatgaaattcctttcattacttctcaagccggcgacttgagagatcaagtgcactgtttgccctttgacttgggg

SEQ ID NO: 338 - DNA, 401 bp, Homo sapiens
tctggttatgtctgcctgactgactactgtaacagggccaggtcattttcttgcttaaacatcttactatagtccataggataaagatcatcactcctactcatgacatatgcacagccattgccagtggtttcaaaaggcttgcacatcacgaaggctcaataaatgttattgatttgaactgaacagtaaatagatcamgatggtataactgccttttagtgctcatagccaatgttctaaaacattctcctggtctatttttttgtctggctgccgtattgctatgatttctaaaaaaacccatagttttctggatcaggaagacactttactggtgggtcaggttatagagatcactgagaatgaagattttagtagtaaaatgatgtaaataatct

SEQ ID NO: 339 - DNA, 401 bp, Homo sapiens
gggaaaaaaagttaatagatttgctgaattttaactatttctctcctttatttttcatatcttttggatatttacttgattaccagggttcaagcaaatgattctcaatttgcttgaatcattgttttagatttattgtttagaataattgttttagattgtttatttcatgctgctttctgtgtgactgctctaggaacraagtcatgagtagaagccagggaggcatgaaagaaaaagtcttgtggcacccacaccgagaagatgctaagcagagatgtgaggaaacaaagctgagaattgagggacaatccaagggaaagaagtggactgggaaatsggttctcctggcctggaaaagacacgtcaccacagraaaaaatctggctccagagaacaat

SEQ ID NO: 340 - DNA, 401 bp, Homo sapiens
ttagaataattgttttagattgtttatttcatgctgctttctgtgtgactgctctaggaacraagtcatgagtagaagccagggaggcatgaaagaaaaagtcttgtggcacccacaccgagaagatgctaagcagagatgtgaggaaacaaagctgagaattgagggacaatccaagggaaagaagtggactgggaaatsggttctcctggcctggaaaagacacgtcaccacagraaaaaatctggctccagagaacaatttattttaatatgcctcattttgctatttcattaattcagaaatacttggcctttttttctactgttactgtggaggcataataggaaatgtaaacatactggtacaaaataagaaataacttatttatatggcaggaa

SEQ ID NO: 341 - DNA, 401 bp, Homo sapiens
ctttctgtgtgactgctctaggaacraagtcatgagtagaagccagggaggcatgaaagaaaaagtcttgtggcacccacaccgagaagatgctaagcagagatgtgaggaaacaaagctgagaattgagggacaatccaagggaaagaagtggactgggaaatsggttctcctggcctggaaaagacacgtcaccacagraaaaaatctggctccagagaacaatttattttaatatgcctcattttgctatttcattaattcagaaatacttggcctttttttctactgttactgtggaggcataataggaaatgtaaacatactggtacaaaataagaaataacttatttatatggcaggaagactagaaaaatcacagccattttcttcttcttact

SEQ ID NO: 342 - DNA, 401 bp, Homo sapiens
gaaacattctctctgatatgtttttaatttgttttattcccattttgctattgcaattttcccacctgccaatggagataaggggctgtttcattctttctcttttggctcgcgaaggccacacgcttgttttgttaaggagagtccacctatcaccaggagggacagaagtcagctcaggaagggagaccctgccagggractcagccatgaggtaaggccagccatgagtccaaagacaagtattcctgagcacctgaccgctatttatcaaacattgttctaggggatgtggggaattgtaagagaagctcaagacagtgttcttgtctgggctgatgaaaccttatcctaattcaggctacagtgaatactttatgtgcaytctgagtgttcctatc

SEQ ID NO: 343 - DNA, 401 bp, Homo sapiens
ggagaccctgccagggractcagccatgaggtaaggccagccatgagtccaaagacaagtattcctgagcacctgaccgctatttatcaaacattgttctaggggatgtggggaattgtaagagaagctcaagacagtgttcttgtctgggctgatgaaaccttatcctaattcaggctacagtgaatactttatgtgcaytctgagtgttcctatcctttccttgttatatggcaggagtttttgatatagggtacatggaccccaggaggcccttggatagaacacaagtggtaaaattccatcttttaaataattaactactaactgaaatttagccatttcttcaattatatatgttggcacaaaccacagtagtattaagagtgtctctgaccttg

SEQ ID NO: 344 - DNA, 401 bp, Homo sapiens
ggaccccaggaggcccttggatagaacacaagtggtaaaattccatcttttaaataattaactactaactgaaatttagccatttcttcaattatatatgttggcacaaaccacagtagtattaagagtgtctctgaccttgtcagcagtagaaaacactgatatttttatataatatcacagttgttgcagatatcttgraacatcatttgtgctttatcactatttttgaaaattatagtagttattagacctgcagctagagtttgttacttaatgcattcatatagaaagacatcattaaatcacatttttctggatacttttataattgtacttcaatgcaattggtgtcttttgtaatcctacgtattttctttcatacattcaaacactcatcg

SEQ ID NO: 345 - DNA, 401 bp, Homo sapiens
atgccttatataaatatatcaatgcaatgatttattattacagctgttatgccatagcatgttgggttgctgacaattttttatttttttttgtgacgaagttttgctcttgttgcccaggctggagtgcagtggcgtgatcttggcttactgcaacctctgcctcctgggttcaagtgattctcctgcctcagcctcccragtagctggaattataggtgcctgccaccatgcccagctaatttttgtattaatttttattattaattttatatttcaccatgttggccaggctggtctcgaactcctgacctcaggtgatccacccgccttggcctcccaaagtgacggtattacaggcgtgagccaccacacctggctgacaaatttgtatgtatgta

SEQ ID NO: 346 - DNA, 401 bp, Homo sapiens
acaagcctgggagatattaaccgagggatcccatggtttctcacttttccattcttccatgaagtcactgtttcacatagcttggagtctgtgaaccatgccaatatatgtgtctttttaacatggttcattttttaagtacatcattggtttggagagatgagaatgagaagatgagttaacttttattgtgaggcaccygtatggtttagactttcactgcaactttgttacaggtgagcgatatgcccttcatttcacagactctgtggggtgtccatcagcacatgagtaaagatcttcctttggagggtaaccactttctgacattaactgtgtcttgatggagaacacagcatatgagttatgagttttggcctgcgagttgtgaaagatgactc

SEQ ID NO: 347 - DNA, 401 bp, Homo sapiens
gaggaaggagcagaattgggaagaggggaaaagtgggctgtgatgcagtctaatcaaagtcataggtaatcccagaggaaagtctgagactggatggctcttggggattgtcatgagttggggcaaaggggtcagtccttcataaccctgagatcagtctttatttgctgcacccagggagaagccatgaccttgagcaargatgcgcttttcagccaggacacttaacaaagagggctgacagctgtcagcacttccagaagctggtaaaataagaccttcattcttaaagggacatcttggcagaataccaatgactattytagtccactgcttataccactcagatacacatcttcatatacatactgaaaatcaatcttctaggatcttagtaggtt

SEQ ID NO: 348 - DNA, 401 bp, Homo sapiens
gcaaaggggtcagtccttcataaccctgagatcagtctttatttgctgcacccagggagaagccatgaccttgagcaargatgcgcttttcagccaggacacttaacaaagagggctgacagctgtcagcacttccagaagctggtaaaataagaccttcattcttaaagggacatcttggcagaataccaatgactattytagtccactgcttataccactcagatacacatcttcatatacatactgaaaatcaatcttctaggatcttagtaggtttcttttgctggcagaatgttgtaagattaaggttgataggataaactggtacccttgcagaaacagctagttgcaagatctcaaatgatatttatcatctctcttcttcactatccacttta

SEQ ID NO: 349 - DNA, 401 bp, Homo sapiens
tgggtgccaaacatatttcttcgtgctccccattgtatataagaatgctactttctttcagggttaattgctaccaccaagatggtgactctttttattttaagctggtcacttgctatgaggaacctgaaatgcccaggtgtcagccaaagcttatattacaactagaattttcctatgtttcctggtggaagcatttcytctttggcttgaacttcaagccatgcagctccaagagttgcaggtatgagaagcacaaatttcccaagtgggtcactgtgagtggtgataagtgggaccactcttgcttccatatatcagttcctggatccatgtattcaagcacctgggatacaataccatataaagatcattgatttagggtgtacagtgtatttggg

SEQ ID NO: 350 - DNA, 401 bp, Homo sapiens
ttgctcatgaacccatgcacattctaactacaggacacttccttttctatgtaaagagctcaccacatgcactgccacttgtcactgttgttaagggccacctcaatgtcaggctgtgatatagctttcatccatttcctgcttgcacacacataccaagccaacccatctctaaaccaattttttttttgtttttgaaawtgatacataataattatatgtgtttatggggcacatgtgatattttcatacatgcatgcaatgtgtaatgaccaaatcargatatccatcaccttaaacatttatcatttttttgtattggaaacattccaaattttctcttctaactattctcaaatatacaataaattatagttaagtatagttatcctactgtgcta

SEQ ID NO: 351 - DNA, 401 bp, Homo sapiens
gtcactgttgttaagggccacctcaatgtcaggctgtgatatagctttcatccatttcctgcttgcacacacataccaagccaacccatctctaaaccaattttttttttgtttttgaaawtgatacataataattatatgtgtttatggggcacatgtgatattttcatacatgcatgcaatgtgtaatgaccaaatcargatatccatcaccttaaacatttatcatttttttgtattggaaacattccaaattttctcttctaactattctcaaatatacaataaattatagttaagtatagttatcctactgtgctatcgaacactagaacctgtccttctaaatgtattttttgtacccattcatcaaccacttttcacgtcctctttcccaattt

SEQ ID NO: 352 - DNA, 401 bp, Homo sapiens
tcactggcaccacagtctgaatttctatagattcttttaatgctttggtcattacttaaagttagcagtctttcatgctacctgacatatgatttggtgctgtattcctgcaatggaatatgctgcctccagaacatgggaacgcctactaggcaaggtgcttccttatttgtgatagaaagtgcaaattgcaataatttktattttctttggaagggatatcccaaaatactcaaaaccataggacttctaaaaatattactaatatatcaggccctgaatctctatagagtttatctcttatcctctagtgtgtatatgttttacctaggcctacaatgtacttgtcacttcttttttctagttggttcaattgccatgacatcctagatatagtggac

SEQ ID NO: 353 - DNA, 401 bp, Homo sapiens
tttttttttttttttttggtgggtgggggtgcggggggtgagtggttgaactaattgaattaattggagatacaatggggctcaccctcctccatccattaggtctttcattgaagccattaaatttctgccaaattccaggaagacctggaatatgacagtttattagagagtaccctggaaaaaatagccatgaaagtraaaaaaaggaagcaagcttggacagaagaaaaaactggactgaaatacaatctcagtgagtaccataactgatctctagagagctcttggtgtgcattggccctacagagctgtcctgagctaggtgaggagactggccttgatagtcttgtattgaccatttcccagatgcgtggtcaaggcagttctcttcaaccaag

SEQ ID NO: 354 - DNA, 401 bp, Homo sapiens
gtggatcacttgaaatcaggagtttgagaccagcctggccaacatggcaaaaccccgtctctactaaaaatacaaaaattagctgggcgtggcggtacacacctgtagtcccagctacttgggaggctgaggcgcgagaagcactcaaacctgggaagtggaggttgcagtgagcagatgttgcgccactgcactctagcytgggtartagagcgatactccatcaaaaaaaaaaaaaattaatggatgcttttggcaaattcaggactgaaaattgctgtgacttttcctccatgagagtttctgcagtttgggtcataagagttaaatatggttaatacttcattaagtactgtttaactttagcaacctaagacattacatgtcatcaattgttctga

SEQ ID NO: 355 - DNA, 401 bp, Homo sapiens
acttgaaatcaggagtttgagaccagcctggccaacatggcaaaaccccgtctctactaaaaatacaaaaattagctgggcgtggcggtacacacctgtagtcccagctacttgggaggctgaggcgcgagaagcactcaaacctgggaagtggaggttgcagtgagcagatgttgcgccactgcactctagcytgggtartagagcgatactccatcaaaaaaaaaaaaaattaatggatgcttttggcaaattcaggactgaaaattgctgtgacttttcctccatgagagtttctgcagtttgggtcataagagttaaatatggttaatacttcattaagtactgtttaactttagcaacctaagacattacatgtcatcaattgttctgactttgtg

SEQ ID NO: 356 - DNA, 401 bp, Homo sapiens
gtaactataaggcagaaagaaaaatggcaacatcagagcataatacgaagattcatgggaaatgggagcagaggagaaggagacccagccttctggggaagacagtgtaggattagagaggaggctgtatttcagctgagactgaggaggggaggtaagacctaccagaaagaagtaccaccaatgtaaacatatcatcaraagtatgttgtgtaatgtatctaagcaatgtagtaaaaaagcgtagtggttaaactttactctcctaggatattgcggtatattttatatttgctatatatagtacatagtagtatacagaatatgtgtatatgtatatgttactacgtaatatacatatactactttccaaatagtatactgcagtacactgccaaaag

SEQ ID NO: 357 - DNA, 401 bp, Homo sapiens
catggtgcccattacttttgcagtctgaggtgtgacagcaaaactggcatgaatttttttcctttttcacaatttcataggtagaagattcatattttactgtaaatcttgaaaacctcagcataagatttttcctttccttattaagttgagaacttacacattttcacttaaaggaagcacttaatggcttctctttcrcagatccaaattatcagcatcactactattgcattttggggctattattaagtgaaataagagtaacttgaatagaagcatagtgataacgcaacagcagatctgataactgagatggctcataagtgactcatgggcagagagtatactgggcaaaaggaggattcatgacctgagtgggatggagcaggatggtgtga

SEQ ID NO: 358 - DNA, 401 bp, Homo sapiens
taaggaaatagagaacttgaacagcactatagacaaattggagccaatagatacagaacactacacccaacagcagcagaatacatattttctcaagtatgcatggaacattctctagaataaatcacatgttaaaatacaaaacaaggcttaataaattttaaaagattaaaatcacagaaagtatcttttttattacartggaatgaaactagaaatcaacagcagaaggaaaactggaaattctacaaatatgtgagttagacaacacgatattcaacaatgaatgggtcaaagtgaaatcacataggaaattgtaaaatatcttgaggcaaatgaaaataaaaacaccatgtgttgaaatgtgtggaatgtaagaaaaacagtgttaagacagaagt

SEQ ID NO: 359 - DNA, 401 bp, Homo sapiens
cagggagcctgaagacaaaattgcaggatggtcccaaccccccagagttcaatcataccacccaagggtattgagctgaaatctgtggccagagctcaagcaggaaggagccccactctcaaaacacagagaagaatgaggcatgggttcctgtgtcagtgtgagtgctagatgttcctccctctgcaaaactggtctggrcaaggtgtagtctgttggccagccacagcttctgtttgagggagccctggaagagcccagtgatctgggcacagaaggttttggacgagtttagctgttcaggcctgctcctgtggcagacactggagggagacctggtagggagatggtgagctgggtggactccacagccatttgctgggctaaaagatcccagggca

SEQ ID NO: 360 - DNA, 401 bp, Homo sapiens
ggcccatattcttaagtgctatctactgtatcaaagcttgaattataccaccaaacaaaaataaatttcttcagcatagaaagcctgtgaaactcaaagcaggaaactagccacaactaaggaacccacacagaactttggccctctgaaagcacccagaaaagaagccaatagattatgcactagaagtaccacagtcargccggatgcagtggctcatgcctgtaatcccagcactttgggaggctgaggcaggcggatcatgaggtcaggagatcaagaccatcctggctaacatggtgaaaccccatctctactaagaatacaaaaaaattagccaggtgtggtggcaggtgcctgtagtccctgctactagggaggctgaggtaggagaatggcat

SEQ ID NO: 361 - DNA, 401 bp, Homo sapiens
aacatttttatatatatcaacagtgttcaagctgagagacaaatgaagaatgcaatctcatttacaatagctataaaaataaaataaaataaaaaataaaataaaataaaataaaataaaatacatctgaccaaagcggtgagagatcggtacaaagataattaaaaaaacactaccaaaagaaatcagaaatgacacaartggaaaaacattccacattcaaggactggaagaatcagtattgttaaaatggacatagtgctcaaagcaatgtacagatacaatgctatcattggtagtttcctatcaaactaccaatgtcatttttcatagaattagaaaaagctattataaaatttgtctggaaaaaagagtccatatagccaaagcaatcctaagca

SEQ ID NO: 362 - DNA, 401 bp, Homo sapiens
ttgggggggtgaagccaagatggccaaataggaactgctccagtctacagctcccagtgtgagcgatgcagaagacaggtgatttctgcatttccaattgaggtactgggttcatctcactggggagtgtaggaaagtgggtgcaggacagtgggtgcagtgcaccgtgcatgagctgaagcagggtaaggcatcacctcwcccaggaagtgcaaggggtcagggaattccctttcctagtcaaagaaaggggtgacagacggcacctggaaaatcaggtcactcccaccctaatactgtgcttttccaatgggcttaacaaatggcacaccaggagattatatcctgcacatgactcggagggtcctatgcccacagagcctcgctcattgctagcacag

SEQ ID NO: 363 - DNA, 401 bp, Homo sapiens
aaggatatccaggatttgaactcagctctgcaccaaacagacctaatagatatctacagaactctccaccccaaatcaacagaatatacattcttttcagcaccgcaccacacctattccaaaattgaccacatagttggaagtaaagcactcctcagcaaatgtaaaagaacagaaattataacaaactgtctctctgaycacagtgcaatgaaactagaactcaggagtaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtggag

SEQ ID NO: 364 - DNA, 401 bp, Homo sapiens
tatccaccatgatcaagtgggcttcatccctgggatgcaaggctggttcaacatacgaaaatcaataaatgtaatccagcatacaaacagaaccaaagacaaaaaccacatgattatctcaatagatgcagaaaagtcctttgacaaaattcaacaacacttcatgctaaaaactctcgataaattagttattgatgggaygtatctcaaaataataagagctatctatgacaaacccacagccaatatcatactgaatggacaaaaactggaaacattccctttgaaaactggcacaagacagggatgccctctctcaccactcctattcagcatagtgttggaagttctggccagggcaatcaggcaggagaaggaaataaagggcattcaatgaggaa

SEQ ID NO: 365 - DNA, 401 bp, Homo sapiens
tatactacaaggctacagtatccaaaacagcatggtactggtaccaaaacagagatatagaccaatggaacagaacagaaccctcagaaataatgccgtacatctacaatcatctgatctttgacaaacctgagaaaaacaagcaatggggaaaggattccctatttaataaatggtgctgggaaaactggctagccataygtagaaagctgaaactggatcccttccttacaccttacacaaaaattaattcaagatggattaaagacttacatgttagacctaaaaccataaaaaccgtagaagaaaacctaggcattaccattcaggacataggcatgggcaagcacttcttgtctaaaacaccaaaagcaatggcaacaaaagccaaaattgcaaat

SEQ ID NO: 366 - DNA, 401 bp, Homo sapiens
ataccacagtgagataccatcttaccctagttagaatggctattactaaaaagacaagcaacagatgctgggaatgatgcagagaaaaggaaactcttacacactgttggtttgaatgtaaattagcacagccattatgaaaaactgtatggagatttttttcaaaaatctaaaaatggaattaccatatgatccaacaakcccactaccaaatatttatccaaaggaaaagaaatcagtatgtcaaagacatacctgcacttggacgtttattgcagcactattcataacagcaaaggtatggggtcaacctaaatgtccatcattgaatggatggataaagaaaatttggtatgtacacacacacacacacacacacacacacacacacacacatacac

SEQ ID NO: 367 - DNA, 401 bp, Homo sapiens
gaaattagaacccttgttcactgttggtgggagtgtaaaatggtacagctgctatggaaaacagtatggtggttcctcaaaaaatgagaaaatgattactatgtgattcagcaagtccacttctgggtatataccccaaagaattgaaagtagggtctcgaggagatagttgaacacctatgttcatattaacattattgrcaatagctaaaaggtgaaagcaacctaaatgtccattgatggatgaatggataaacaaaatgtggcatatgcctatgatggaatattattcagccttagaaaggaaggaaattctgacacatgctacaaatatgggtgaaccttaaggacagtatgccaggtgaaattggccagtcagaaacagaaatactgtatgactc

SEQ ID NO: 368 - DNA, 401 bp, Homo sapiens
atattttcccatttagtaagatattggcttaggatatctatctatctatcttatcatgctaagaaagaaattttaagtttcttttttttttagtgttttcaccaggaatcagtattgaatttcatcagaggatttttcattatctatggagatacataattttttttcttagatttaataatgtggattataataccaatrggttatctaatattggaccaactttgcattctgaaagaaattccacttagttgtgttgtattgatttcacaatgtataagattctgtttgctaatgttttagttggtatttttacatcaatatccataaacatactgctctgtaggtttttttttgtatttttaaaaatttagatttaggtattagtgtagtacttgctt

SEQ ID NO: 369 - DNA, 401 bp, Homo sapiens
taaacatactgctctgtaggtttttttttgtatttttaaaaatttagatttaggtattagtgtagtacttgcttcttaaaaattgggaactttttattcatctttaatgttctgcagcactctataaaacattggaaatatcaaatctttgatgattcggtagaatttttttccaaagttatctgggcaaggtgctttttkgttgatgtttttcttaataacttactttttatcttctatggaaaatgttgtctatctataactgagtcaaatatcatttattttattgccctaagaaattatccatttcctctgttttcaaacctatttgcatagaggtctgcaaaatagtcacgatattttaaatttttgtttcagtggttgtttccccttgtcatctt

SEQ ID NO: 370 - DNA, 401 bp, Homo sapiens
aatttttaaatcagaaatatttagtttatttagttctgtgacttttcctctaaatactaatttcaatacatctttccattattatttttcagaaattttgtcatgtaagtttgtattttccctttaggtagaatgttttctaataaacattttttcttaaaatttgcgtggaagagtctttttgctctttaattctgttarcaatttctagtttttattgcattatgatatttattgttgtgatatttctactttttgaaacttactgatattttctttgtgacttaatatttgattatgttttgtaaatgttttattgcacttgagaagaggtgtattatttactgtatggctgtaagtttggtatatgcttataaagtttggtatatggttataaaatc

SEQ ID NO: 371 - DNA, 401 bp, Homo sapiens
tggaagttagcagcaggacaaggattagcatccagaccaaacattatgtgaataaatgagaaaaataatatcaataaaaggaagtgatattttcatagagaaggacacagaattggacgtagtggctgatatttgtaatctcagcagtttgggaggttgaggtgggaggatcacttgaggccaagagtttgagactagccygggccacatagtgagaccctgtctctacaaaaaaaatttttaaaaatagctgggtgtggtggcatacaactctagtcttagctacttgggtggctaagacatgaggattgcttgaacacaggaatttgaggttgtagtaggctgtgatcgtgccactgcacttcagcctgggcaacagaacaatatcttacatctacaga

SEQ ID NO: 372 - DNA, 401 bp, Homo sapiens
ttctgcctcaaccacctgagtagctgggactacaggtgtacaccaacacacccagctaatatttttattttttttgcagagacaaggtctcactatgttgtccaggctggtctcgaactcccagactcaagcagtcctcctgcctcagcctcccaaagtgctgggattataggcatgagtcaccatgcccaaccaagactrattatttttggaacctgttttaagatgtgttggcattctcaatcaggtttagaatagttgtatagactatacacgaagattcaaaacatttcttaaaatattctatttttagccagtttgcatttaagtactttaaaaagggggcatttcatcagagacaatgctaggtatatttaccttactatatccatggctctatg

SEQ ID NO: 373 - DNA, 401 bp, Homo sapiens
tctgagaggccctaaacgttcagattctaaggtatgcagtgtagtagaccatcttctggatctaaaggactctttcaagggagaacagtagccctgtcaagatttcggggacattagtaaaaatttgcagagagatgttttctacatgcctatgacctggaactatctgtggaagatggtaaacaaagaatgttaatactragtttgttttgtgttacacagtttaaaatgcggtgagaaagccaggtgagactatgaaattttggagctggtgtattacattgtgcatggataagtactgtatttgctcttccaaaccagagatcaggtgaaattatgaagacaaccttttcaggtattatatagggagaaattaaagagaaatttatttgtgtttttat

SEQ ID NO: 374 - DNA, 401 bp, Homo sapiens
gaaagcattctaataagtaatttaaaaaaataagcttcattgagttacaatttacatacaagaaaattaatacaatgaattttacagttagaaatgcataatttgatgaattttggcagatgtggatagtcatgtaagtaccacaaaagtcatgatatagaacatttctatcatccaaaaagagttctttcatgttccacrtcaattaatgtcattgctccacaccttggaccctggtaactaatgatttgttttctattgctataattttgccttttctggaattttatattcatttttttttgtggccagctttttaaacttttcatactgcttttgagattcacctatgttgtatgtattaatagctgatttctttttatgacagagtagtattccat

SEQ ID NO: 375 - DNA, 401 bp, Homo sapiens
ggatttcatcaaaataaaaaacatttgatttttaaagacaccactaataagatataaaatcaagccacagactgggagaaatgattcacaacacgtatatgaagaaagtaacttatatgtagcacaggcaaaaatacagtcatgactcattaataagacaaacactaaataaaaaaataggcaaaaggtatgaatagactyytccagaaaagatatatggatggcaaataagcacattaaaaagtcactagggaaatattaattatgatcmcaataaaatatctctatatacatacatattaaaatggctacaaatggtaaaaaatgaccattccaaatgttggcaaggatctggaggaaatagaactttcataaactagtttgattgtaaaattgtacaa

SEQ ID NO: 376 - DNA, 401 bp, Homo sapiens
gatttcatcaaaataaaaaacatttgatttttaaagacaccactaataagatataaaatcaagccacagactgggagaaatgattcacaacacgtatatgaagaaagtaacttatatgtagcacaggcaaaaatacagtcatgactcattaataagacaaacactaaataaaaaaataggcaaaaggtatgaatagactyytccagaaaagatatatggatggcaaataagcacattaaaaagtcactagggaaatattaattatgatcmcaataaaatatctctatatacatacatattaaaatggctacaaatggtaaaaaatgaccattccaaatgttggcaaggatctggaggaaatagaactttcataaactagtttgattgtaaaattgtacaac

SEQ ID NO: 377 - DNA, 401 bp, Homo sapiens
actgggagaaatgattcacaacacgtatatgaagaaagtaacttatatgtagcacaggcaaaaatacagtcatgactcattaataagacaaacactaaataaaaaaataggcaaaaggtatgaatagactyytccagaaaagatatatggatggcaaataagcacattaaaaagtcactagggaaatattaattatgatcmcaataaaatatctctatatacatacatattaaaatggctacaaatggtaaaaaatgaccattccaaatgttggcaaggatctggaggaaatagaactttcataaactagtttgattgtaaaattgtacaaccacattggaaaacacttttggcagtttctttaaaagttttatacataccctatggcccagtcattccac

SEQ ID NO: 378 - DNA, 401 bp, Homo sapiens
atcaatgaatgttatgaaatttcacaattcattagagaaaaatgaagtttaaatggtaagaatataaactcttaagttaatatgcttaataattaagaacttttgccttggagtagatgaagaaacccaagaattatatattaatttaacgaagagaaaaatatctatttaaagaattgaccattttctaaaattccagarcaacagtgcacataattggatgctcataacaacacagaaaaggatgctcagtctgtgaagttcagtctcaaccagttttgcattttatcttcatctttaatatcaggatagatattataacttaatgctttggtattttcctcaatatttcctttgggagactgaattttttcatagataaaagggaggtatacagatac

SEQ ID NO: 379 - DNA, 401 bp, Homo sapiens
ggcgtcactcggttgcccaggctgcagtgccttagcacaatcatagctcactgcagcctcaagctcttaaggctcaagggatcctcccacctcagcctcctgagtagctgggaccacaggtgtgcaccactgtgtctggctcctattacacagaacattttacttggttttctcactgattttgtgatgttgtcctaattmcatagcgctggcacaaagattatataagcagtagggtactttgtggactcacgtgtggccaggtttgtcccaggatcttcaccctttcactcccttacttgtgactcaccccagcctatacagtgggaagaaattgaggtggagttgaagggattcatagaggtaatgaccccttggattgctggggagggctgtggcaa

SEQ ID NO: 380 - DNA, 401 bp, Homo sapiens
tttgcctttcctggggctgccagggagtacagaatcgggagtgaaactgatcctgagcgagtgcacagtgctccttgatgattactcctccgcaaattcagagactggcgcttactgcttatctggggaattctgaaggcaagggggcagctggaacagccataacgacagcaaaatgagggggtgtccgagagtagcctrctttttttaatcctgtggcatggaaaggatgtgtgactttcccacagatgaagaggatgctgtgaaaggtaaaagctcccttaaaagtttcttgcttcaaaggtggcttgctaaggcaagagaacaccctagtagtaggttgggatgggaggagatatatcattaagaataggtaagggagaatgtcaagaggcgagcac

SEQ ID NO: 381 - DNA, 401 bp, Homo sapiens
ctttagtcttctcttcctctgttctgaccttagagaaaccagaagagtggggtaaggataggaaggaaaagagaaggaacagtccagtttcttctccaccactgcagccctgagttaggggagtagaagagaagctttgaattggatatgaaattaaattttgatttagactggaccagatacctttaatccctgcatggrtgccatcattgatggaatggggcttctttgtatacctgagagaatggggcagctatgggatctgcctgagacaaggactgagagatgcatatccaacaaagcatgcttaaaagcagtgattggagagaagtaaagccatttcctgctaagttcagactgttcagtcaattgattatactgagagagattatgcagtaaag

SEQ ID NO: 382 - DNA, 401 bp, Homo sapiens
ggaatggggcttctttgtatacctgagagaatggggcagctatgggatctgcctgagacaaggactgagagatgcatatccaacaaagcatgcttaaaagcagtgattggagagaagtaaagccatttcctgctaagttcagactgttcagtcaattgattatactgagagagattatgcagtaaagttatttagctgackggtaaagagtctctttggggatggtgtgcccagcgcacaaggttaaggagttggaagatttcttctgtgaataaaatcaatgtttggggctcagtctatcgggaatgacttattactagtactaaaatttgtgtgtgtgagatttaataagtctttaatatggtcttcatttgttgcttcatttattcaaacatttatta

SEQ ID NO: 383 - DNA, 401 bp, Homo sapiens
tttgagcccaggaactcatgctatgctgcttctcataatataaggtatttcctctaatacagaatttaatttagactgtgactaagtttaaagacaagattacaaggagaaggattaatgtgacctgaaaacattggataagacttcagactcatatgttccaatgctcctggaaggccaaccataaatggaaggtgtatytttaggacctggaatgaaagggcacggtagtatcatttcagagtttcagctgtttgtaatatttattataatatcttttttggtcttatcacccagagacatgttctttgcaataaaatagacagcttaatagatttctttaatattatttggagcagacatcataatttcatttagactttaagccttaggagatatct

SEQ ID NO: 384 - DNA, 401 bp, Homo sapiens
attatgtatcctatcacttccagaaacagtttttggaagaaagagagtctaggcctacagcttcttaggaaggcttaacacagggtttttagttgtgctattgtggctcctaggcaaagtgcagaaatgagagagccagtacctgagtcctaaacctccttctgacaacaatcctcttcatgaccctgggaagggcaatcmactttccggaacctttttatcacatatgaaattaaggggtttggactagatatctaggattctttcctggtctaacatttgatgtatttctctatggttcaaagcataacctaatggggaagtttatgacattctaacatggcatactgggttaggagtggatgttaaaatatttatttataccactctttcatcagtaa

SEQ ID NO: 385 - DNA, 401 bp, Homo sapiens
tacagaaaaaactggtgtgaaacttaccagtagggcaagaagttgattacctctcttgttttgatctcttttattacatgtctttgttttgcaggcctctacacttcagtgccctccttgacctagtaataaactctcctccacactgaagccttcactgaaaacttcggaatagaagttggcataaagtatagtaattaygactttcgtggactgaygtgtatgttaaggacttcaaagcatcctactattcagatgtgtggactgtgctaaagtagaagaatctataaaaccaaaggaaaacaaaagtgacaaaactggaggagttttatttttatggagwcagatgggcaaagtaaggtaggttgaatgccacttcagttctaaaagtctatttattt

SEQ ID NO: 386 - DNA, 401 bp, Homo sapiens
tgaaacttaccagtagggcaagaagttgattacctctcttgttttgatctcttttattacatgtctttgttttgcaggcctctacacttcagtgccctccttgacctagtaataaactctcctccacactgaagccttcactgaaaacttcggaatagaagttggcataaagtatagtaattaygactttcgtggactgaygtgtatgttaaggacttcaaagcatcctactattcagatgtgtggactgtgctaaagtagaagaatctataaaaccaaaggaaaacaaaagtgacaaaactggaggagttttatttttatggagwcagatgggcaaagtaaggtaggttgaatgccacttcagttctaaaagtctatttattttctcttggtctgactgg

SEQ ID NO: 387 - DNA, 401 bp, Homo sapiens
acactgaagccttcactgaaaacttcggaatagaagttggcataaagtatagtaattaygactttcgtggactgaygtgtatgttaaggacttcaaagcatcctactattcagatgtgtggactgtgctaaagtagaagaatctataaaaccaaaggaaaacaaaagtgacaaaactggaggagttttatttttatggagwcagatgggcaaagtaaggtaggttgaatgccacttcagttctaaaagtctatttattttctcttggtctgactggaagtgccatctatatagcccaacattttcaagagaaggatgacgatgaaggcttccatggcaaaataatgagaaaattgtcaaattgtcaaaaatcaagctttaggattcaacctttgacactca

SEQ ID NO: 388 - DNA, 401 bp, Homo sapiens
ggattcaacctttgacactcatgattcatgatatgctttctttactcagcagtggtgtgtgttactttaaatgtttagaaaacatacatgtgcatgtatctttatagcagcatgatttatagtcctttgggtatatacccagtaatgggatggctgggtcaaatggtatgtctagttctagatccctgaggaatcgccacrctgacttccacaatggttgaactastttacagtcccaccaacagtgtaaaagtgttcctatttctccacatcctctccagcacctgttgtttcctgactttttaatgattgccattctaactggtgtgagatggtatctcattgtggttttgatttggatttctctgatggccagtgatggtgagcattttttcatgtgt

SEQ ID NO: 389 - DNA, 401 bp, Homo sapiens
tcatgatatgctttctttactcagcagtggtgtgtgttactttaaatgtttagaaaacatacatgtgcatgtatctttatagcagcatgatttatagtcctttgggtatatacccagtaatgggatggctgggtcaaatggtatgtctagttctagatccctgaggaatcgccacrctgacttccacaatggttgaactastttacagtcccaccaacagtgtaaaagtgttcctatttctccacatcctctccagcacctgttgtttcctgactttttaatgattgccattctaactggtgtgagatggtatctcattgtggttttgatttggatttctctgatggccagtgatggtgagcattttttcatgtgtcttttggctgcataaatgtcttctt

SEQ ID NO: 390 - DNA, 401 bp, Homo sapiens
ttcatatccttcacccactttttgatggggttgtttgtttttttcttgtaaatttgtttaagttgattgtagattctggatattagccctttgtcagatgagtaggttgcaaaaattttctcccattctgtaggttgcctgttcactctgatggtagtttcttttgctgtgcagatgtgcagaagctctttagtttaattmratcccatttgtcaattttggtttttgttgccattgcttttggtgttttagacatgaagtccttgcccatgcctatgtcctgaatggtaatgcctaggtttccttctagggtttttatggttttaggtctaacatttaagtctttaatccatcttgaattaatttttgtataaggtgtaaggaagggatccagtttcagc

SEQ ID NO: 391 - DNA, 401 bp, Homo sapiens
tcatatccttcacccactttttgatggggttgtttgtttttttcttgtaaatttgtttaagttgattgtagattctggatattagccctttgtcagatgagtaggttgcaaaaattttctcccattctgtaggttgcctgttcactctgatggtagtttcttttgctgtgcagatgtgcagaagctctttagtttaattmratcccatttgtcaattttggtttttgttgccattgcttttggtgttttagacatgaagtccttgcccatgcctatgtcctgaatggtaatgcctaggtttccttctagggtttttatggttttaggtctaacatttaagtctttaatccatcttgaattaatttttgtataaggtgtaaggaagggatccagtttcagct

SEQ ID NO: 392 - DNA, 401 bp, Homo sapiens
actattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcacaaggacaaaaaaccaaacaccrtatgttctcactcataggtgggaattgaacaatgagaacacatggacacaggaaggggaacatcacactctggggactgttgtggggtagggggaggggggagggatagcattaggagatatacgtaatgctaaatgatgagctaatgggtgcagcacaccagcatggcacatgtatacatatgaaactaacctgcacat

SEQ ID NO: 393 - DNA, 401 bp, Homo sapiens
cacatgtatacatatgaaactaacctgcacattgtgcacatgtaccctaaaacttaaagtataataataataataataataataataaatgtttagaaaaaaattctatcataaatatgaccatttaatttcctacaagtttttcaaaagtttcttcttgggtttattcatccctatggaaaattccttagagagatttargaatcttcagtgaatacttttagaacaaatggaaagaaagcaaaaatgctgtttcatcattgagaaaaataaaactcaaaacaagcttaaccatcaaacctcttctttattccaatttgtcatatttgtaatagcaacaataagctsttcttagaaataatgtgttcttagaaataaataaaatgcatgtttcttactgc

SEQ ID NO: 394 - DNA, 401 bp, Homo sapiens
aagtttcttcttgggtttattcatccctatggaaaattccttagagagatttargaatcttcagtgaatacttttagaacaaatggaaagaaagcaaaaatgctgtttcatcattgagaaaaataaaactcaaaacaagcttaaccatcaaacctcttctttattccaatttgtcatatttgtaatagcaacaataagctsttcttagaaataatgtgttcttagaaataaataaaatgcatgtttcttactgctaaatgccagtgtacaatgaaatttccaagccaattttttggggaaaaggtgtaacttctgtataatgtatttaggatcttaagtggcatatttctgttggatggtttatatgttatctatagatagcacctcactactaaggcata

SEQ ID NO: 395 - DNA, 401 bp, Homo sapiens
agatggggagagacaagactgtcggccccacaccagcaatcactgactcagtctaaacaaagagtaacataataatggtatacaacagagaatcaccgtttaaattttatgaccaggtctttaataagtatcttgcagcctgttatagaaaaacactttcaaatagtgtgatatgtctcataatgggaaaagcgtcccccrgaagtactgagcatccagcaataaaggcatttaagtagacatatcatatgatcaactttaagaggcagtttccaacatgtgttgtcttcattgccggattggaagaaacccgggggcaacgtatcatttatttagcrtaacattgtattttgcataatactagagtttctaaagaattttcatatatactaagctatttt

SEQ ID NO: 396 - DNA, 401 bp, Homo sapiens
gcctgttatagaaaaacactttcaaatagtgtgatatgtctcataatgggaaaagcgtcccccrgaagtactgagcatccagcaataaaggcatttaagtagacatatcatatgatcaactttaagaggcagtttccaacatgtgttgtcttcattgccggattggaagaaacccgggggcaacgtatcatttatttagcrtaacattgtattttgcataatactagagtttctaaagaattttcatatatactaagctattttaatccttgcaagcaycctgtgaaataaagcaaggactctgcttatttaataaataaggaaagaggctcagcatgattcataaattttcctggagtttcaggactggcaaatagcagaattggagtgtgatgccagcc

SEQ ID NO: 397 - DNA, 401 bp, Homo sapiens
ccagcaataaaggcatttaagtagacatatcatatgatcaactttaagaggcagtttccaacatgtgttgtcttcattgccggattggaagaaacccgggggcaacgtatcatttatttagcrtaacattgtattttgcataatactagagtttctaaagaattttcatatatactaagctattttaatccttgcaagcaycctgtgaaataaagcaaggactctgcttatttaataaataaggaaagaggctcagcatgattcataaattttcctggagtttcaggactggcaaatagcagaattggagtgtgatgccagccaattatatccttaaactttacatatattgcccagtgtaaaagttcaagaatgcttatttctttgttatctggaaaggg

SEQ ID NO: 398 - DNA, 401 bp, Homo sapiens
tacttctactgagtagagaaactatgtatttatttatatgtatgttaaaaatgaaaccaacataggtcatttgggagaagaactccttagaataaaaatattttaaaaagtggatttaaatatctgagttagaatatttcactagcactaggggatcgttcttgttgttgtggggtatctataaatcctctgaatgtaggraaagtcttaccatatgtcctgatgtattaagtaagactaggagctttagacaacagagaattaaaacagtgagctgtacttcctctggcttgtatatttatagcaaatgagagcaaaagatgtgattgggcgggttattgcccttgtcaaatataatctattcattcttccggaaatctcctttgcttcgatacctattt

SEQ ID NO: 399 - DNA, 401 bp, Homo sapiens
cacaatatgtatcctcatttacttacatcttctttgatttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaasggtccccagagtgtgatattccccttcctgtgtccatgtgatctcattgttcaattcccacctatgagtgagaatatgcggtgtttgatcttctttgatttatttcatcagtgttttatagttttcagtatacaagttagaactattgttatatttattatacctaaatatttttattttttgagtgattataagtgtta

SEQ ID NO: 400 - DNA, 401 bp, Homo sapiens
cttgtatcttgcaaccttactgaactcacttattagttctatgcactttttttatagattctttgggcttttctaaacagaaaaacctgtcatctggaagtagggactgttttctttctttctttgcagtcagtctaccatttatttcgttttcttgtcttcttggactggctagaacttccagtactatattgaataaargcagtgagagcagaaatgcttgccttgtttctgagaatagtgaggaagcattcagtcttttatcatcatgtgtaatgttagctgtasgttttttgtagatactcttcatcaaactgaagttctcctctatgcctgtgtttctgagagtttttatcaggggtaagtattgaattttggcaaatactttttctatatcctgt

SEQ ID NO: 401 - DNA, 401 bp, Homo sapiens
tgtcatctggaagtagggactgttttctttctttctttgcagtcagtctaccatttatttcgttttcttgtcttcttggactggctagaacttccagtactatattgaataaargcagtgagagcagaaatgcttgccttgtttctgagaatagtgaggaagcattcagtcttttatcatcatgtgtaatgttagctgtasgttttttgtagatactcttcatcaaactgaagttctcctctatgcctgtgtttctgagagtttttatcaggggtaagtattgaattttggcaaatactttttctatatcctgtgtagttttccaaacttggaaactcttctgcactctagctgccttcacatgggcaagtgttttcatatcattctgtgttcctctgtat

SEQ ID NO: 402 - DNA, 401 bp, Homo sapiens
atcaggccaggattttactcctggctccttctatcctttgcatagtgagatcatattctctttgagtctgtttcttcatttacaaatagaagaaaaatagctgcagtgatgatcaggtgacttgatagaggaaatgcttagtcaatgtaattggtttatagatagtaattaatgtgagagttttccccagatttttatagwcttcctttatcatttattgctttaccacaataagtcatttgtcaaggaggaacacgtatatttccctagagaacacaccgatwtgagaacatacgaagcctacactcctcattcaggaacaggcaagagacaagtgtacatctagttccaccaagaaaacacacacacacattaacataccagtaatagtaagaaagctt

SEQ ID NO: 403 - DNA, 401 bp, Homo sapiens
aaatagaagaaaaatagctgcagtgatgatcaggtgacttgatagaggaaatgcttagtcaatgtaattggtttatagatagtaattaatgtgagagttttccccagatttttatagwcttcctttatcatttattgctttaccacaataagtcatttgtcaaggaggaacacgtatatttccctagagaacacaccgatwtgagaacatacgaagcctacactcctcattcaggaacaggcaagagacaagtgtacatctagttccaccaagaaaacacacacacacattaacataccagtaatagtaagaaagcttttatggagattctgaaacatctattagaccttgaaagataacttagtatttacatgggaggagacacacttcaacctaccacg

SEQ ID NO: 404 - DNA, 401 bp, Homo sapiens
tgtcaggatggaaagtaggttggtctgatcaagggagtcctgtcatgggaggtgagaagacctgggatctggtactggatttgcttctcactcctaacatgatcatgaaaatattttctgcttccttccttattagcaaaatcaggtagatataaaaggctctgaagcagactgggttgttgtaatggcaaagggggaacytaaaaaattctggactgagatgtgggagtcacaccattgtccactgcagacataccaaacaagccaccttaatttagagcacaggcttgtgagtctagtgatgctgttcaatcatacattttaatctctataaaatgtaatctcctatgcacaaaggtagtaccaatagcacttgagtgcctcgaagagagttttgccca

SEQ ID NO: 405 - DNA, 401 bp, Homo sapiens
tttttgtccttgcgatagtttgctgagaatgatggtttccagcttcatccatgtccctacaaaggacatgaactcatcattttttatggctgcatagtaacagcaggttctggagaggatgtggagaaataggaacacttttacactgttggtggggctgtaaactagttcaaccattgtggaagtcggtgtggcaattcytcagggatctagaactagaaatacacgtatgtttattgtggcactattcacaatagcgaagacttggaacccacttcccacttttgtttcctttaattgcccttatgagaccacatccaaaatcccaagtcctgccaagtgaatgcagtacttaaagatttgactactggatgtctggtcttggagaaaacagtcaagag

SEQ ID NO: 406 - DNA, 401 bp, Homo sapiens
aagccaatgtgcagaaggccttgtttcactacccctaaaacagtgcatgtgcaggaggactgttattgctgtgctttggaaggtctgtggatgaggaaatgtagaattgcagatttatgggttggaagttgatttagaagacacatgtaacagaagtaacaatcttatcagacttaccagtgtcttccacttatttccttwacttcagatgctcaggaacgacagcacytgcagaatgcatccactgctgaaaaatgagagctgtttcttgttggtactcttcagggacattttagcatagtggtggactccagtgttgacttttcttttcatcatctgtttgatcttggtggattcttaagaatctctggacctgagtttgttcatctgttgattggggt

SEQ ID NO: 407 - DNA, 401 bp, Homo sapiens
ctacccctaaaacagtgcatgtgcaggaggactgttattgctgtgctttggaaggtctgtggatgaggaaatgtagaattgcagatttatgggttggaagttgatttagaagacacatgtaacagaagtaacaatcttatcagacttaccagtgtcttccacttatttccttwacttcagatgctcaggaacgacagcacytgcagaatgcatccactgctgaaaaatgagagctgtttcttgttggtactcttcagggacattttagcatagtggtggactccagtgttgacttttcttttcatcatctgtttgatcttggtggattcttaagaatctctggacctgagtttgttcatctgttgattggggttcatggtagccacttctcaaggttatga

SEQ ID NO: 408 - DNA, 401 bp, Homo sapiens
ccttacttccttcagattttcgctcagataccatgttattcatgaggcttccctggccaccccatttaaaagcagcaccccaccagcattgcctatcacccccaccctgctctgtattacctgataacactaatgaccgtctggcagattatatctttatttgcatatttattatctgtattctgtctttagaatgaagayagaggctttattccagtgactgaaacaatgcctgacatgtaatggaactcaataaataattgttgaaataatgaatgaataaatgattagcctttaatttgtattcattcgtacacattacattggggttttctagaagacagtatgaaaatttcacttaatttgtgactcaagtacagaaagaacgatagagatcagag

SEQ ID NO: 409 - DNA, 401 bp, Homo sapiens
gtaaagataaatgtaattgtttttgaaatcaaccacttgtccctaatgctcaatctgtgcttctgagaatttgccgagtttcaatgctttaatgtgtgtattgaacagggctttctgttgcaaatagcagaatttgcacacgctagttgaatcagaaaacaataacgtaacaacagatactaataaacacgtagaatctcrgagagtgccaaagagcagggttctggggctacacagccacaccttaggacttctctctaatcatatgacttctcagcacctgtgatgccaggacttggcctcccaaagctgaggaaccaaatgcctcaccaactgctcctgccagaaaactggttctccctggtttggtgcccatactctttgaattttctggctttaaa

SEQ ID NO: 410 - DNA, 401 bp, Homo sapiens
ggatttctgttgtccttcaatcaaccatctacctaagcctcaaaccgttttgttttgcttaaaaacagaatgagtttggcaaacctagaaaagtacacaaaggatcatccatggatataggatggaagatgtatgaatatggaccaacaacagtgtttattttaataattctaatattgttataagttgtcataagcttaytttcgtaattagagaatagtcttcaatttacactgaatgcatgtttggcaaatatactaatgttatatatgtacttctcttgttcagggcagtcacttgttttaagtaacatgtttatctttattaaaatatgaatttcatgcggttttacagcaaggttattggttaaatcaatattctcaattaatgaaactagtgac

SEQ ID NO: 411 - DNA, 401 bp, Homo sapiens
acacgtggaggatactagaggctgccatgacaatattagccaaaaaatgataaaccacaacgtgatagaaggaagaatcctcactttatagttgagccccgagtaagtgaggaaagttgtgcaagtttgtaacttcagtgtgatggttgaggatggaattaaagtctcctgactgcttatgaaacctcccacctatatgtktttacgcaaaatgtcatggcccttacatccttttgtttccattgctatgatggttctggattgtaatcctataagaatatgatcacttaatgaatttatgttcattatatttcatatgcagcctgaaatgcctctggtttctttattagcaaatcaacagaaaacacttgataaccagattcaagattagacagcaaaga

SEQ ID NO: 412 - DNA, 401 bp, Homo sapiens
agggatcttaagaaatttttttagaaaggatatgggaccctaaaactattgaagtaacaagaaattaggacaagaaactaatatgggaccctaaaactattgaagtaacaagaaattaggacaagaaactaacagtgatagaggaagggtactggcttgttagatttgggctcaccgtttggcaatccatctctaaacccyatcacaacttatttataataataatcttggtgctgatcatcataatctgggtatgcagatttacctacataattttaggcaaattggttaacccctctggacatttaattcctcatctgtgaaggagttacacaagaatacatttattggtttaaataactactgttcaatagagaatttttaaattagcatctgtagct

SEQ ID NO: 413 - DNA, 401 bp, Homo sapiens
tttcttgtatctctgtcactcacaatattacctaatgctatctaatgtattctgttcttagagaagtaaaatgtctcagtagaccaaacttagatttgatcattacgaaagatgtcattctcagtggctggatcttcatgaggttttcttgagctgtttttcatttcacctgctgctggatgttttaggctgctgtattcrcatctggtggcctgtctcactaggatctcatggctgcccgggcagtgtcacagctctgagttcaggttggctctagtcttgcccttcgctacagaatcgtggaatacagtgggagatgaagaaggcagcactcttgccctttgtgtttctagtaacttaaattcaactcctggcagcctacttcacattctgatttgggc

SEQ ID NO: 414 - DNA, 401 bp, Homo sapiens
acacccatgtaattcacaggcatctgtccacaggtagtttgagaacctaactatattaaatttcaatattcagcaaatagctcataaccaatcatatctgaattagaaaagcatgtgtaaagaacaatagcaccaactagcactcatagcagattattccagctatgttataataaggcccttggcaataactcaaggtckgttttttcaaaatgtaaggattaggtgttcttgaggcaggaaagaaaaacaagactattctttgcagatggagaaaaaaatgaagtagattcactagcagagtcactttcatggaaatttggagctctgctgcacagttttagtgtttaaacaggattggaagtcctttgggatgacattttcaatgctgaaagagaaac

SEQ ID NO: 415 - DNA, 401 bp, Homo sapiens
ctgattttggtaaaactaagcacacaatttaaatttatcttggaaaaccttagtagttattggaattacttgagaatctattgcaagcaatctaaatgaattcttccaaaacatgtcactggagcaggtactcaagaagtaatctgaagtaaacaaacaaaaacaaagctatatttatccttcctcttttctgtgtaatayaatccatgggaagacaagaagaaatttattttctacttgtgagatttggggatgatgatgctttttctatccttatcaccatttgtcaagatacaactttcattactttccagtaccacctttgaacagcatcttcttttttagtatattctcccttcctccttccatctctccattctttcttccctcctcttttcttc

SEQ ID NO: 416 - DNA, 401 bp, Homo sapiens
caggtgctgcaataaattgtttgccctagatcgaggtggggagagagccctcttaggatgagctgtcacacagtaaaagataagatttcctggatcagttttctaaagtgacaggcgtgtcccctaatcgagacagacagtgctccattttgacaaataggccagacttctacgtgtgcatatttgttttgtgtgtgtcasagtgagggtgaggttgaggagtcattctgttcttattggaagtgaatcaggcataaaagtgatagagcgcttgaatgagatgattgcagttgaaagacacagcaattaagcagatttcagactttagagagcatgtcttccgggagctatccacggtactgaactgcttctccctatattgtcctgtaaccccgcaaaac

SEQ ID NO: 417 - DNA, 401 bp, Homo sapiens
atagagcgcttgaatgagatgattgcagttgaaagacacagcaattaagcagatttcagactttagagagcatgtcttccgggagctatccacggtactgaactgcttctccctatattgtcctgtaaccccgcaaaacaaaccttcaaacattttaaaaccacaagacattttaaaaactggctttggttattccttackagacaaattctctaacctgtgtatttctaatacttgttatttgtttaatcttggctaggtcarcccatttttttttgtttgatattacacattcatccatttatttattcaacaaatatgtaggtacaatcttccgtatgttgggcagcctcctagtggttaaggtgcttaggtttcttattatgtaatgctaattatta

SEQ ID NO: 418 - DNA, 401 bp, Homo sapiens
tagagagcatgtcttccgggagctatccacggtactgaactgcttctccctatattgtcctgtaaccccgcaaaacaaaccttcaaacattttaaaaccacaagacattttaaaaactggctttggttattccttackagacaaattctctaacctgtgtatttctaatacttgttatttgtttaatcttggctaggtcarcccatttttttttgtttgatattacacattcatccatttatttattcaacaaatatgtaggtacaatcttccgtatgttgggcagcctcctagtggttaaggtgcttaggtttcttattatgtaatgctaattattattacttttgatttttctgggatttactctaaggaagcagatttaatgattaaaataattctac

SEQ ID NO: 419 - DNA, 401 bp, Homo sapiens
tggaggataagctcctttcctagagatacttactctacttttggtcatggaccaaatttggagttattcctgtggatttttttctcttgttccttaaggcagtgatagatgcttgtttagtcaccataagttgtgagaatatgtggtctcaataaagacccagcaataccttgtttttctactcattatccagccccaaartttaagatctaaatgtttcctggtgagaatacaaagaaaagtgagctcttatagcctgttgatgggaatgtaaattagtgcagccattatggaaaatagtagagaggcttctcaaaaggctaaaaatagaactaccatatgatccaacaattgcactattgggtatttatccaaaggaaacaaattcaggatattgaaga

SEQ ID NO: 420 - DNA, 401 bp, Homo sapiens
cactgattttaacacacattggaaatatgcataggcaaaccccaaacaactttttattcaatagtgtccatgtatctctaaacttttgatagaaatttgttccaataatggggttactacataagttgaagaaagtcaaactgaagcaaaatttgaaggcttctatattaatgatcagttttaggcgatacttgccaaaayctagttcaggattagaataggctgtgttgacattttaagtgagacatatcagttactctttttcagaaagttaaaataaattctcataatgaaaaaataaatgataattttagattcttttagagaatttactacctttacaaattaggaaaataatattcacagtatccatgattccaaccagttaacatgttggtata

SEQ ID NO: 421 - DNA, 401 bp, Homo sapiens
agctgggactacaggcacctgacaccacgcccgccaatttttttgtattttttttttttagtagagacggggtttcaccgtgttagccaggatggtctcgatctcctgacctcgtgatccacctgcctcggcctcccaaagtgctggggttacaagtgtgagccaccgttcccggcctctccagtgtcctatctcaattcytattcaattgtttgttaactagattggaatcatactgtgcatattgttttataatttgctgttttggctgacatttggaaaaattattttagaaaaaacagccagttttgtagatgaaatggtgttttgtttctattgatttttgatttttaagttgctattacttcatgaagttagcgtctttcttgtgtattggctat

SEQ ID NO: 422 - DNA, 401 bp, Homo sapiens
actggaaaactaattgttcagcatcctaagtgtatttgttgcttaattatatatataatttctacaacaagtggaatgatttacatgaatgtcaaataactggtttataaatgaaacctgatattaagctaaataaaatattggcatatagtgttcacttatgagctaatattcttacctctagcttcatttacaaattarttatgctacaaatatattaatgttccacaactctttcacacttccatcaatatcgagtttattccattacaatgtgaaattaaaaaaaactgtagaataattacttctgcttcagaaaatatagattacctatcttccagtaagatgctgcaatttatttagataactgcatttattgcattgattttgaaaaattgctc

SEQ ID NO: 423 - DNA, 401 bp, Homo sapiens
ttaatatacattaagagttttatttttggaacaacttagtaatttttagaaacttgagtacaagtgttggcaaaggttctataaaattctgtctacagaatatgtggaacacaaccttgggtcgtatctccaaggaaaactaccatgattaaaaagacaatgctttgtcaaattcacttgttatcacaatctaattgtgtwaaatgccggccacattytgagtagacactttaacttggcttyccttgggaaataggaaatgaagggcccgaaagaactagaagctgcctctcaattttytttcaacatggcaaaagcatttgcatttatctgtgcccctctcttggctacactctcagctttgatacactacttgagcatgtggaggtttacctactgaa

SEQ ID NO: 424 - DNA, 401 bp, Homo sapiens
ttttatttttggaacaacttagtaatttttagaaacttgagtacaagtgttggcaaaggttctataaaattctgtctacagaatatgtggaacacaaccttgggtcgtatctccaaggaaaactaccatgattaaaaagacaatgctttgtcaaattcacttgttatcacaatctaattgtgtwaaatgccggccacattytgagtagacactttaacttggcttyccttgggaaataggaaatgaagggcccgaaagaactagaagctgcctctcaattttytttcaacatggcaaaagcatttgcatttatctgtgcccctctcttggctacactctcagctttgatacactacttgagcatgtggaggtttacctactgaatgtgacccttatatgaa

SEQ ID NO: 425 - DNA, 401 bp, Homo sapiens
tttttagaaacttgagtacaagtgttggcaaaggttctataaaattctgtctacagaatatgtggaacacaaccttgggtcgtatctccaaggaaaactaccatgattaaaaagacaatgctttgtcaaattcacttgttatcacaatctaattgtgtwaaatgccggccacattytgagtagacactttaacttggcttyccttgggaaataggaaatgaagggcccgaaagaactagaagctgcctctcaattttytttcaacatggcaaaagcatttgcatttatctgtgcccctctcttggctacactctcagctttgatacactacttgagcatgtggaggtttacctactgaatgtgacccttatatgaataatatgagacttttgtatcaacag

SEQ ID NO: 426 - DNA, 401 bp, Homo sapiens
atatgtggaacacaaccttgggtcgtatctccaaggaaaactaccatgattaaaaagacaatgctttgtcaaattcacttgttatcacaatctaattgtgtwaaatgccggccacattytgagtagacactttaacttggcttyccttgggaaataggaaatgaagggcccgaaagaactagaagctgcctctcaattttytttcaacatggcaaaagcatttgcatttatctgtgcccctctcttggctacactctcagctttgatacactacttgagcatgtggaggtttacctactgaatgtgacccttatatgaataatatgagacttttgtatcaacagtagtgatggtttttgtttttaagtcacattttattgtatgtcttctctacctctcac

SEQ ID NO: 427 - DNA, 401 bp, Homo sapiens
cgttatatggaaatgtgacatgttttagatttgtgtaagctcatgtacttgaaaatcagacttgtctaaaatttcttttgtaagatattagagaacttttgaattatacctcttatttttgaatgtacattcctcagagaatcatctttatgcacaaataatgtttattttatatttttaatctactttagcagacccacstgattcttctacatgtaaggttgaaacagttttgagtgataaagaactgattttatggagcaactaatgattttgctgttgctacttttgtgccagcaaatacgtaatccacaagaatgttataagaaagatatttatcaagcctctaaaaaaraagaaagtaatcaaaagataaggatgcataaatatcttaagactac

SEQ ID NO: 428 - DNA, 401 bp, Homo sapiens
caaataatgtttattttatatttttaatctactttagcagacccacstgattcttctacatgtaaggttgaaacagttttgagtgataaagaactgattttatggagcaactaatgattttgctgttgctacttttgtgccagcaaatacgtaatccacaagaatgttataagaaagatatttatcaagcctctaaaaaaraagaaagtaatcaaaagataaggatgcataaatatcttaagactactcatgacatcaaggaaggtgaatcagtattaataattcactagtttgtgcatacttattgtcaggtgctgggtcaaattaaattggaatgatttgttgacatgaggatttctgggttcatgatggattcacattaaaacaatttttatgtttta

SEQ ID NO: 429 - DNA, 401 bp, Homo sapiens
caaattaaattggaatgatttgttgacatgaggatttctgggttcatgatggattcacattaaaacaatttttatgttttaagccttctcccatcaaataggttttacggtcttgtgtacacattacatgagggaaatagtactttaacattttacatgctggtgtatagtctatatcagcagtccccaacctttttggcwccaggaaccagtatcatggaaggtaattttgccatggagtggggttggggaaaggagatggtttagggatgaaaccgttccacctcagatatcaggcattacattctcataagaagcatgcaacctagatccctcaaatgtgcagttcacaatagggttcgtgctcctatgagaatctaatgctgccactgatttaacag

SEQ ID NO: 430 - DNA, 401 bp, Homo sapiens
agcagtttataaatggaagaaatggctttacatatcttgtttcctgaatccctttggatattttaaaagaggtgattaaagtaaatttatgtttctgcagatgcatgtaaagctaattgttttaataacagtataattggcgaaaggaagttatgtgtaataagaaacaaagcgtaccacttccaaaatattcacattagrcatttgttaaatttgcagtgagtttcagcatacacacatacacaacacagaccatatgtgaacattaggaagattgatttgtttaaaaaatccacttctacaccacataagtaatatttcttactgagagtcactgaagtgaggaagaaaaataaccacataaygggaaaagaaaaacattaaatttagttatattgtat

SEQ ID NO: 431 - DNA, 401 bp, Homo sapiens
aaacaaagcgtaccacttccaaaatattcacattagrcatttgttaaatttgcagtgagtttcagcatacacacatacacaacacagaccatatgtgaacattaggaagattgatttgtttaaaaaatccacttctacaccacataagtaatatttcttactgagagtcactgaagtgaggaagaaaaataaccacataaygggaaaagaaaaacattaaatttagttatattgtatatgttttgtgtttattagtttttattaattgtaggcatgcaggtaaaaaaatcgcctcatttgaaaattaataacccagggcacaaactattaattaaggcatatagcaaatgccttttaaaagtattttatactggctgggcatggtggctccgcctgtaatc

SEQ ID NO: 432 - DNA, 401 bp, Homo sapiens
atgaccatacgtaggaacctgcttcttctcttgaaatggctgttttgttttatggagattggctagactggcaggtgacaaggcaagaggtgggctggccacgagagccagctgagcagtgcgagttggtgtgattcagccatttgtcaccaccatattctgccatagatagatattttctattcgagaaagtggatcaamtttcactgtacaccactttctcactakgstagaaatacatgaatggtggggcatagttcactccaaatmtgatccatctaaacttttctttctggtgagttgatctgttttgagattttacactttacataaaaatagtatagcagccactctttgccagtcacaaaccacctttagctgagagtattatcatatcaatt

SEQ ID NO: 433 - DNA, 401 bp, Homo sapiens
ctcttgaaatggctgttttgttttatggagattggctagactggcaggtgacaaggcaagaggtgggctggccacgagagccagctgagcagtgcgagttggtgtgattcagccatttgtcaccaccatattctgccatagatagatattttctattcgagaaagtggatcaamtttcactgtacaccactttctcactakgstagaaatacatgaatggtggggcatagttcactccaaatmtgatccatctaaacttttctttctggtgagttgatctgttttgagattttacactttacataaaaatagtatagcagccactctttgccagtcacaaaccacctttagctgagagtattatcatatcaattgtttcaaggaaatgacaaatgagtagt

SEQ ID NO: 434 - DNA, 401 bp, Homo sapiens
cttgaaatggctgttttgttttatggagattggctagactggcaggtgacaaggcaagaggtgggctggccacgagagccagctgagcagtgcgagttggtgtgattcagccatttgtcaccaccatattctgccatagatagatattttctattcgagaaagtggatcaamtttcactgtacaccactttctcactakgstagaaatacatgaatggtggggcatagttcactccaaatmtgatccatctaaacttttctttctggtgagttgatctgttttgagattttacactttacataaaaatagtatagcagccactctttgccagtcacaaaccacctttagctgagagtattatcatatcaattgtttcaaggaaatgacaaatgagtagtta

SEQ ID NO: 435 - DNA, 401 bp, Homo sapiens
ggcaggtgacaaggcaagaggtgggctggccacgagagccagctgagcagtgcgagttggtgtgattcagccatttgtcaccaccatattctgccatagatagatattttctattcgagaaagtggatcaamtttcactgtacaccactttctcactakgstagaaatacatgaatggtggggcatagttcactccaaatmtgatccatctaaacttttctttctggtgagttgatctgttttgagattttacactttacataaaaatagtatagcagccactctttgccagtcacaaaccacctttagctgagagtattatcatatcaattgtttcaaggaaatgacaaatgagtagttaccaaaaaaagaatgaatgaatgaataaataaataaacaca

SEQ ID NO: 436 - DNA, 401 bp, Homo sapiens
tatgcccagtaaatttttcataatttgtagagacagagtttcgccatgttgtccaggctggtctcaaactcctggactcaagcagtctgcccaccaaagcctcccaaagtgctgggattacaggcatgagccatcgtgcccaaccatagattttttttttcataatggcagagaatggctgcaatttagggtctttcttargttcttcctcatccatttcttgcagaaaatttagtactttgtatttctttcaataatttcaacaattttatcctgacttttcccagagcaaaaattaggatggggatgttagagcttcctttgagcaggctatcatcgcaatgaaatcttgaccttgccccttgtagttgcctattgctttataaaacttgttattgaaa

SEQ ID NO: 437 - DNA, 401 bp, Homo sapiens
ctcaggagttcaagaccagcctgggcatcaacacaagaccttgtctctactaaaataattttctaagaatagctggatatggtggtgtatgcctgcagtccctgctgctctggaggctgaggtgagaggattgcttgagcccaggagactgaagcttcagtaggctatgatcacatcactacactccagtctgtgtaacaraatgagatcctgtctcaaaaaatttaaaaaataaaatgaaaaagaagatgctacgtacattatacacatataaattagtaaccaaatggtttaacaacctcagtgattgtgttgttctgtagtttgatgacttttatcttgctccttctcattgccattgattgtaccaggttatttcctggagcatgttgtatatcaag

SEQ ID NO: 438 - DNA, 401 bp, Homo sapiens
tttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaatratcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctcc

SEQ ID NO: 439 - DNA, 401 bp, Homo sapiens
atgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcrtgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaat

SEQ ID NO: 440 - DNA, 401 bp, Homo sapiens
aataacagctaatgttcattgagtgctaatcttccaggtactgttcaaagagttttacctattatcaactcaattctcccaacagccatatgatgttgttactgttattatagataaagccacttaggcacaaagagattaagcaactagttcattgttacagagttggaaatggaaagccaggtcctaacccaaatgctstgttgcgcacttctctgctgtctgcaggtgggatgagaggtgggtgctgagctgcctcctgtggtgctgttttgaaacctgcccatcccaaagctaagggagtatcgctgtgctaaagggttcagtcagcagccttgccagttcggaatcccctagaaccaccctccatgcatgtcatgggcagctctctgagatttctg

SEQ ID NO: 441 - DNA, 401 bp, Homo sapiens
ttaccttataacttgatttcagaatatagttacacaaagtgagaataactcgatgaggatgctgtttggatcttgagtactgtaagtcctgtggtttaattgacgagttgatggatttcttttatgcctaaattcaggctgaaaggcctaaaggccacacgaggcagtttatcacgagcgctattctccgtttttatattmtggttcattaccagccccttcctcagtacttctatttatataatgttgttctggtcaaggtttatactaaatctcttttaacttcaacatccaacaaatatttttaaggactaatgtgtgcaaaacattatgctaggtgtttcctaaggcttcaaataacttggatgccagttttggactgtaagtgctcacaggataat

SEQ ID NO: 442 - DNA, 401 bp, Homo sapiens
gaaacagatccctatgccaaaaagttggggattgcagctttaatagactcagaggcatagtcttagagtgtaacaaatgcacaaaccttttcttttaaaacagactccagagggattgaagagagggaaccagtgataatctatatgcccatttcatggcagacatgctgctgtgtgctttccatgcattatatcattcakccaacaggcatctaaagaatatagagtcaagaacagttaagccattgccacaagatcacctagctagtaaatggctcaaactcagtgactcaaacccaggatttccaaccttaaataaggctctcactcccacaccgcacagctgcatatctgagtgtttatcagtgaattacattgatgtaaattcatttatgaaaatg

SEQ ID NO: 443 - DNA, 401 bp, Homo sapiens
tcttgaggcttctgcattcttcacgtagttctcgagccttggtttttagctccatcagctcctttaagcacttctctgtattggttattctagttatacattcttctaaatgtttttcaatgttttcaacttctttgcctttgatttgaatgtcctcccgtagctcggagtaatttgattgtctgaagccttcttctctcmgctcgtcaaagtcattctccatccagctttgttccgttgctggtgaggaactgcgttcctttggaggaggagagtcgctctgctttttagagtttccagtttttctgctctgttttttccccatctttgtggttttatctacttttggtctttgatgatggtgatgtacagatgggtttttggtgtggatgtcctttctg

SEQ ID NO: 444 - DNA, 401 bp, Homo sapiens
ccccctgctttgtttacctaagcaagcctgggcaatggcgggcgcccctcccccagcctgctgccgccttgcagtttgatctcagactgctgtgctagcaatcagcaagactccgtgggtgtaggaccctctgagccaggtgcgggatataatctcctgatgcgctgttttttaagccggttggaaaagcgcagtattcakgtgggagtgacccgattttccaggtgccgtctgtcacccctttctttgactaggaaagggaactccctgaccccttgggcttcccgagtgaggcaatgcctcgccctgctttggctcgcgcagggtatgcgcacccactgacctgcgcccactgtctggcactccctagtgagatgaacccggtacctcagatggaaatg

SEQ ID NO: 445 - DNA, 401 bp, Homo sapiens
tcaaagtcaaatggaacctggaaaatcgaacttaattccattttacatttttcccttgaccatttcccatggtggggaggtatgtgtctagatttggaaaataagcctgcttagttttttttcccagctcagtgcttagaaacaaccccctctagcaaaaccatgcctaggaaaacaaagtatccagctaggctttcaagrttacttgggggcaagacatggatagttacgtccttggaggaaaataaatacaaggcagtagatccaaatgtatttgtcatgcaaagaacattagctgagagagagcttccatatataggtttgcaaaactgagagcaaagccaaagccattcctgggttttgctttgtgatatagtctccaaatggatactattatgatt

SEQ ID NO: 446 - DNA, 401 bp, Homo sapiens
aaagcagtcattcaatcactcagtaatttttagggatttttaaaatagatataacaattttaggatgtcaagttttagatgtctagttttaacttgtttggttgagctgacatttaagttcagtcccaatgtgatgtgaatggacctagccttttacctcttctttttttcctcttcattggaaaccagtacagagaacayggtcacttaataagaaagatgtttcctgctttgtttccttttattcaactcagaactgcctgggggaaaagattgcttcctttctgaatgtggtaagccacaaaatggaaaatgtgcacacgagctctttcctattaaccttggggaaaggtgacagaaatgtgtgaacaatgctgttagctgtttaaatgttcttttat

SEQ ID NO: 447 - DNA, 401 bp, Homo sapiens
taaaagataatttggccaactgtattggaccaactgctcttgaactctctaagtacaattggtttaagatattgcctgaaatgactattttgcttatggtgtcattctttcatggtcaagatgacagttctctaggaatgttatttcatttctagaatgtcagccaaacagctttttatgatcctgagcagttatactctwmcatcccaaacacacacacacacacatacatcttacacacacacacacacacacacacacacacacacacacacacacacaaataagccctgagaattttcagagaaattcatggtggaagatctgagattagaacccaggaactcctaagattccttggttttgtatcaaaggtcaataaagagacatgaagtcaatga

SEQ ID NO: 448 - DNA, 401 bp, Homo sapiens
aaaagataatttggccaactgtattggaccaactgctcttgaactctctaagtacaattggtttaagatattgcctgaaatgactattttgcttatggtgtcattctttcatggtcaagatgacagttctctaggaatgttatttcatttctagaatgtcagccaaacagctttttatgatcctgagcagttatactctwmcatcccaaacacacacacacacacatacatcttacacacacacacacacacacacacacacacacacacacacacacacaaataagccctgagaattttcagagaaattcatggtggaagatctgagattagaacccaggaactcctaagattccttggttttgtatcaaaggtcaataaagagacatgaagtcaatgaa

SEQ ID NO: 449 - DNA, 401 bp, Homo sapiens
tgatctcctgacctcgtgatccacccgccttggcctcccaaagtgctgggattacaggtgtgagctactgtgcccgtccttgttttccttttgtcaagaaagccagacattctgtgacacggtaaatgaaaaagggcttggacccaaccccagctctgttgcttgcttgttgcgttgccataagagaccctcaagaagaayctcacaaaatccactgccctcccttagtctcgctttcccactaaatcgctccatgcaaggggagccatttatattgcattaaacttttctcggtgttctctaattccaggggttcttactgcctgagagggtcactccaccatgtgggtaagcggggtgtccagagtctgcccataggccatcagcatcagtttttcaaa

SEQ ID NO: 450 - DNA, 401 bp, Homo sapiens
tggattttgatgtaggttagagactgtttataatcatcggagcctagattttattttacttaaatcgcagagtactgtttttgctattttaatatgctgtaagttttcccagaaaacaacttgtataaattgacaaaacttattttgttcagaatttttccaggagatgctcaatatttcagaaaacgacctatctaaagrcaatagtgtttgtggcatttaagatagaaataaagtacaaaccgtcagtctgcatgcaaactgtagttactgtattctcacgattctaattatgggtgcaggcacccaggactttgctatgttttcaaatatagtttttttctattgctatatatggaaattcttataattttattctgaattaataaccttacatcttt

SEQ ID NO: 451 - DNA, 401 bp, Homo sapiens
catgaaagtggcatcctgttggcggagcttgcagtgagccgagatcgcgctactgcactccagcctgggcgacagagcaagactccatctcaagaaaaaaaaaacaaacaaacaaaaaaaggaagtggcatcccattatctttgctgtattccattggtgacaagtaaggtatagattccacatgtactcaaggggcacgyattacacaagggatgaccactcacctgcaaggataattgaggaacattttcgattctgttcaacacagccaatttcctatagcagtgttaggtggaggggatgagttattgggatcagaaggtagctagtgtgttctgtagtctttattccaatgaaagataactttacccattaatgtgaagtcaattgtactcagaga

SEQ ID NO: 452 - DNA, 401 bp, Homo sapiens
gatccagggtcagatctggaagaggtagagagcatttttttaattccttatttaaaaaatgtgatttttgtgggtcatgtgaaggtttgttataaagataaacacgtcatgggggtttgttgtacatattattacatcattgaggtattaagctcagtacctggtagttatcttttctgctccgcttccctcctcctaccstccaccctcaagtagacctgagtgtctgttgtttccttctttgtgttcctaagttcttatcatttacttccctcttataagtaagaacatgcagtatttggttttctgtttctgcattagtttgctaaggatgatggcctccagctccatccatattcccacaaaatatatgattgtgttcttttttatggatgcatact

SEQ ID NO: 453 - DNA, 401 bp, Homo sapiens
ctgagagcatttaagagtcaaatgtattcatgacataaatgtgtattgaaaatctgatatgttttagtgattgttttatagggagggggcagagactctgcttttatgaagcttacagtgagtgccagccaccattttagcttttgggggccttctctaagaagggtggagtagttaatgtagacaaacatgggttttggmagcatacgaccatgaattaacattatatttccgcttaccagccgtgtgattttagcttacgaaagctactctctggttgtttatttcttcaagtgaagaaatgggtctaatagtacctatcacacaagattttctgtgaagattttgtgagatcctrtatattaagcacccagtgcataggtgttctcaatgttaaatcc

SEQ ID NO: 454 - DNA, 401 bp, Homo sapiens
taagaagggtggagtagttaatgtagacaaacatgggttttggmagcatacgaccatgaattaacattatatttccgcttaccagccgtgtgattttagcttacgaaagctactctctggttgtttatttcttcaagtgaagaaatgggtctaatagtacctatcacacaagattttctgtgaagattttgtgagatcctrtatattaagcacccagtgcataggtgttctcaatgttaaatcccctctccatgtctgaaccttcaataaaacagactattacaaattacatatgaagactttgatgtttaacgtcatccacacaaagttaggcaaaagtcatatataacaaatatttaagtaatcacctggaacaagatctctttagttattttttaaat

SEQ ID NO: 455 - DNA, 401 bp, Homo sapiens
agtcagcagccatcaacatcaagggaagaccctccaccagcaaaaagattatgactttctgaagattcagatgatcattagcatttttagcaataatgtatttacaaattaaggtatgtacatttttcagatatgttattgcacacttaatagactacagtatagtacaacttttgtatgcactgggaaaccaaaaaattyaggtgacttgctttattatgatgttcactttattattcagttcactagaactgaacctgtaatatccctaaggtatgcctatgcttgaaaaatgttatcagtaagatgtgtaatgtgtgacaaatccagataatacattacttttggagaagctgagctgtttcaaaagtgttccttttatttgaagaagaagcagagta

SEQ ID NO: 456 - DNA, 401 bp, Homo sapiens
tgtgtgacaaatccagataatacattacttttggagaagctgagctgtttcaaaagtgttccttttatttgaagaagaagcagagtagcccaatcaagtaattttatttattttgaacttacacaataatttacgcttttgtttttcagcaagtagtaagggaggtgggttaatctgaaatgaaatgttcttagatcctgytgttcagttggttggagggcattaaagatagttattacttaagatctctgttgttttgaaattcccattttcctctgacctaaattctatgatgtaaaagaatcccagccaccacagatagactgtttttccttatttaaatgctttaaaatttagttttgacggaatggtctcttaatagaattcttgtgattctgtaa

SEQ ID NO: 457 - DNA, 401 bp, Homo sapiens
taaatcctgggaaaaatgaaaagagtcttccttatgcagttgtgttttgctgctgagttgtgtttgcagtgtattagaagaaatacatgtaggaagcctgttttcagtacaccactgtattactccatggtcttgaatttctgaggtcttaaaatagggttattaatattacggagaaagtcacactgctgggtaatctgrttgaaatggagacagagcataaaccaatagaggtgtacacatatactaagaattttgactggttaagggaaacaagaaacaaatgtatttgttttcattagtaaatatgattttttctcaggatatgagtaagaattagtgaagagggaacaatattaaattattttccttagtaaggtaggatattaaaaattaatccc

SEQ ID NO: 458 - DNA, 401 bp, Homo sapiens
ccatggaaatggcagtaaagacagaacaaagagaatacatttctgaatatactgaggaacatatactccagagagcagaaacaggaagaggggcctctgctaaagctgaaggagtcttcaggagggaacccagctgggctctgtgttctggttggcagatacagagagtagccaaggtcaaaagcagacaaacagaaagtkaggtgattggccacaggtttggaaatggctcaggtttgctctttccaaccccttgcatgtcactgcacatttacctccagaagtaaagcaggagaactctgcaaagggaaccaacamtctgcatgggagggcattgcctccaagtgtgtgggctggcgaccaagtgcagccctctgccctagttatgggagttggagagg

SEQ ID NO: 459 - DNA, 401 bp, Homo sapiens
tcaggagggaacccagctgggctctgtgttctggttggcagatacagagagtagccaaggtcaaaagcagacaaacagaaagtkaggtgattggccacaggtttggaaatggctcaggtttgctctttccaaccccttgcatgtcactgcacatttacctccagaagtaaagcaggagaactctgcaaagggaaccaacamtctgcatgggagggcattgcctccaagtgtgtgggctggcgaccaagtgcagccctctgccctagttatgggagttggagagggacttactggtttgcatgttccatgcaagagctaaagcaaagcacatctcggagaagtgagccaggaaagtggatcaatccatgccaacaacctatattaattaacctgataattaa

SEQ ID NO: 460 - DNA, 401 bp, Homo sapiens
gtacctataaaaccttttagaaaaaaacaggagagtgtctttcagatctaaggtgagccaaataatgggtcgacttgatactgagatcacaacttataaatggaaatgttgataatttggactttgtaaaattaaaaacctttgccctgcaaaagaccctttaaaaggatggaaagacaagctacagattgggagaaaatrtttacaaaccaaatacttgatctaggactagtaactcaaaagtcaacagtaaaaaattttagtaacaatctattttagaaaatgaacaaaagacacaaagagatatttcaccaaagaggatatacatttggtgaaaaagcacatgaaaagatgttcaaggtcattaaccattaagaaaatgcaaattaaaactacaatga

SEQ ID NO: 461 - DNA, 401 bp, Homo sapiens
aaaagcacatgaaaagatgttcaaggtcattaaccattaagaaaatgcaaattaaaactacaatgaggtatcactatccaactatcaaaatggctaaaataaaaagattagtgacgagaccaatcgctggcaaagatgcggagaaactggattactcattcattgctgctgggaatgtaaaatagtacagcccatactagraaagagttcaatttcataaattaaacatacaactaccatatgacccagcaattgcattcctaggcttttctcatagagaagtgaaaacttgtgttcacatagaaacctgtacgctaatgttgaatgttcacagcaactttatttgtaatagctgcaaactggaaacatctccagtgtccactaatgggtgcatggttaaa

SEQ ID NO: 462 - DNA, 401 bp, Homo sapiens
tccactaatgggtgcatggttaaacacattgtgatacatccataccatggaatagtattcagcaataaaatagaacaggcatgcaatggaaagttacatgcaacagcctggatgaatttccagagaaatatgctgagtgagaaaggccaatctcaaaaaattacataatgtatgatctaatttttataccactttgaaacmataaaattaaatgaagaacagattagtggttgccaggggttaagtaaagtgggaggaaagtggttgtggctataaaagtgccacatgaggaatgcttgtaatgatggaattgtctgtttcttgactatgagtgtcaatatcctgaatgtgatattgtgagatgttaccatgggggcaactgggtaaagggcaaatggaat

SEQ ID NO: 463 - DNA, 401 bp, Homo sapiens
ttgaaataacaatttcagaaggatcagcataatgaatctaccagtcactgaaaactctcaattatctgtcttgtcttccctttcagtttttgtttcatttctgttttagtaacctcttagaaaaaggtagtattaaaggagacctaggtctcttttaccaatttaggataacttcacaatctccgcagataaattggtatstgtgtacacacacaaaaataggaaattcttgtgagtagtttacaggggaagtgcttaatatataaacaaggcagtgctctggtaaaattacttattgcattgagattaagaacataataaaattattaaaatagcctaccactttcattacagacttaaaatgttcttccttttatctctgggggttkgataatccctgt

SEQ ID NO: 464 - DNA, 401 bp, Homo sapiens
ataaattggtatstgtgtacacacacaaaaataggaaattcttgtgagtagtttacaggggaagtgcttaatatataaacaaggcagtgctctggtaaaattacttattgcattgagattaagaacataataaaattattaaaatagcctaccactttcattacagacttaaaatgttcttccttttatctctgggggttkgataatccctgtttattgttcttttattttgctgtatatcacgttggccatttaatcattggctctttagcagggtgggtgtagagagcattaaaaaataataaatgatgcagtttatcatcacctccctgtaaaacacaaggcacgtgaaggatatgagtttcctttaagctaacgtatttacttaatgtgatttcaaa

SEQ ID NO: 465 - DNA, 401 bp, Homo sapiens
gtgaaggaaatcagttaaagcattcaaataaagagaaaaatgtaaagagaaacattagtatatttgctatataaatggtaaacgttttatatgtcaaaaatcatttgtatattaaatatttatattaatctgtcatatgtggtagatgattaatatacctagcatataacatgctcatataaataataaaaaaatcataasagaaaacaagacaaaagccrtatatgtagataattcatcaaatggaaaattataaataagcaaattttgaaggaaaataaaataatatgttctatgattaaagtggtcaatgtcttttaaaggctaatattaatagctgacttgtggtctgtaaagaatagtttatttaacatgtgacttataaaaatatataacacttt

SEQ ID NO: 466 - DNA, 401 bp, Homo sapiens
cattcaaataaagagaaaaatgtaaagagaaacattagtatatttgctatataaatggtaaacgttttatatgtcaaaaatcatttgtatattaaatatttatattaatctgtcatatgtggtagatgattaatatacctagcatataacatgctcatataaataataaaaaaatcataasagaaaacaagacaaaagccrtatatgtagataattcatcaaatggaaaattataaataagcaaattttgaaggaaaataaaataatatgttctatgattaaagtggtcaatgtcttttaaaggctaatattaatagctgacttgtggtctgtaaagaatagtttatttaacatgtgacttataaaaatatataacacttttggacagcatttttagagat

SEQ ID NO: 467 - DNA, 401 bp, Homo sapiens
atgcagatcattgttattctataaaatgcagtaccattcagtcattcaaaaatacatttccaaaaaatgtttagagaaaatgctaaaattatgctaagtgaaaattcagacaatatttaaaattttaatagtctgacagattctgatatagataaacagaaagaaagaaaggtaatgtaattttcatgtaattgtacccawgtatatggggaaaaaaggcttgaaggcagtatacaacaaaatgttaaggacttgttatttgcatctactatttcaagaattccttctgaatataaccaacagtttatgcacaaagaatttaattgcaatattcttaataacggtgaaagtcaaatattcatcaataggtaagtgtttaaattacattatcaaatactcrg

SEQ ID NO: 468 - DNA, 401 bp, Homo sapiens
awgtatatggggaaaaaaggcttgaaggcagtatacaacaaaatgttaaggacttgttatttgcatctactatttcaagaattccttctgaatataaccaacagtttatgcacaaagaatttaattgcaatattcttaataacggtgaaagtcaaatattcatcaataggtaagtgtttaaattacattatcaaatactcrgatgatakaattctatgcaggcattataattatgtctttgaagtgtttctgttttaataatatgtaaaagtgcttatgatataatgctaagtaattaaaccatatgaatgtatgttaaaaggctgcatgaaaatatggtaaattgtttgcataggttatcattgagtagtgaaatcataattgctatttctttctttttt

SEQ ID NO: 469 - DNA, 401 bp, Homo sapiens
ggggaaaaaaggcttgaaggcagtatacaacaaaatgttaaggacttgttatttgcatctactatttcaagaattccttctgaatataaccaacagtttatgcacaaagaatttaattgcaatattcttaataacggtgaaagtcaaatattcatcaataggtaagtgtttaaattacattatcaaatactcrgatgatakaattctatgcaggcattataattatgtctttgaagtgtttctgttttaataatatgtaaaagtgcttatgatataatgctaagtaattaaaccatatgaatgtatgttaaaaggctgcatgaaaatatggtaaattgtttgcataggttatcattgagtagtgaaatcataattgctatttctttcttttttcttttttt

SEQ ID NO: 470 - DNA, 401 bp, Homo sapiens
gtaattaaaccatatgaatgtatgttaaaaggctgcatgaaaatatggtaaattgtttgcataggttatcattgagtagtgaaatcataattgctatttctttcttttttctttttttttttttttgagatggagtctcgctctgtcgcccaggctggagtgcagtggtgcgatcttggctcactgcgagctccgcctccygggttcacgccattctcctgcctcagcctcctgagtagctgggactacaggtgcccaccaccacgcccggctaattttttgtatttttagtagagacggagtttcactgtgttagccgggatggtctcgatctcctgacctcgtgatccgcctgcctaagcctgccaaagtgctgggattacaggcgtgagccaccgcac

SEQ ID NO: 471 - DNA, 401 bp, Homo sapiens
tttgttgatggtaaaattctgcctttgcatctgaaattggaaactcttctaatcctggagtctgagtgtaattaatcggaaggctttctcttatctgtgtctaggatcagcctttagtctgatcttcatttttatccaggtgcaaaactcaaatacttttacctttagtgcagtggcccaaattttgtccctagttctgcytgtgctatcattaactgtcattttttaattatatctacacacgaatgtgggccagaggcagcaagatctggattttctcttcctctctgagtccctgacccttggattgttcttccttcttttcaattttggtgggttctgggtttagatttgtagcctaacctagtcaacaacttctttggcatagaaaagaattattt

SEQ ID NO: 472 - DNA, 401 bp, Homo sapiens
agtcaacaacttctttggcatagaaaagaattatttctgatgtgtatattttcccagaagttagaatacccctttgatatatttatttgtgtttaatccacagaaagaatgaagaattaagttatattaacaagagtatcttgcagtatatatatgctttaaagttcacagtgactttgacatgcctctttcatttagttwtcacaactcttggaacgtgtttttgcccattttctgcataagaaaactgaatttcagtaaaattaaattgtttttcccaggcaacccagccaggaatcactagtccccctctctcaaaatccagcatttgctcactagaccagagctgctttaaatgacaatagtgtatggaattcattatagtagaatccattctaaac

SEQ ID NO: 473 - DNA, 401 bp, Homo sapiens
gttgtaacccaaccatgtaaggcacatgttcttaagatctcttgagggatgtgtctcaggctactggtcattcacatttggctcagtctaaatctcttcaaatattaagagtttgactctttgacaactaatacatatatattttaataaccactatgtgccaggaactgtgcttcatatatattattgtgtaattctcaragtaattcccatgacataactatagtacatctgttttaaagatagagaaactgaggctcaaaaagactaagtattttgtaaatattctaagactggaaataatatttgatttcaagattttcttattccaaaatgtgttctgatctgctgctctaccccatctctactaaaaatacaaaaattagctgggtgcagtggtg

SEQ ID NO: 474 - DNA, 401 bp, Homo sapiens
ggtgtgaatcactgtgcccagcttatttattctttctttttttttgtacccattaactatcctacctctctttgtcccaactgcccttttcagcctcttgtaaccatccttctattccctattctcatgagttcaatcattttgatgtttagatcaatatgggacttatatttttaagcattttgatttaattttcatcckttggccaagcttggtgttctgcatttgcaaattttgttagggtacagggtagtcatggctgcaatctggagaaaataatattcaagatagtgttccaggacttattattatcatttcttactggtccattggctgagttggaataccagctaatttattagatataccctatgcttccattgtgcaaacctcagcctata

SEQ ID NO: 475 - DNA, 401 bp, Homo sapiens
aatgaataagaagataataagacgaatggaagactacattctttctactgactggtcatcggtttttctaaatcttggtcctttatctccaatgggtctttgaggacaagcacatcttatgtactttgtaaatatttgctgtttatgcacattttgagtatcattgtttagctttgcttttcagatgcatgaaacaagtamatttgaggcagcaaatgagtaatttgtaaatctagacacaatgagaaggcaattaagaatgctgcttgatgaaaaagaataagagaataatgttgtaggtaagggacaaactaatttcactaatagtggctttatatacagtccagtatgtgaaaatacttaagtaattaacattaacattcacactgtcatcctaggta

SEQ ID NO: 476 - DNA, 401 bp, Homo sapiens
tttctactgaagcccagtaaatggttttgggagacatttgaaatcttagtcatattcaaatcccaaatacaatttctcttttttttcccagaaatttcaaaggttttagaaatattttctactggaaaggtatctctcattcttactcaaaatttagacactaatgagtagatggcaagtcttgtttataagcattaatcrtgaagatgaacatttataactgaaaaaagatgttcgaattttggggtttgtaaaagaactaggaatggagaacatttagagttcactatgtggtgatattcacaaaagcaaatgatgatataactatgtcacttggaaggagcttcaggcaggttctttctcttctacatgtaacatgtaagcctgttttggggtcattg

SEQ ID NO: 477 - DNA, 401 bp, Homo sapiens
ctgtttcccactccatgaaacggaacttattccattcaacttcgtgtaaagtcttttcaaatgacacaactgtaattaggaaagatgtcaataactatttacagatatttatgttgtattcagaactgtactagttagagtgtgtggtttaaaaatttaaaaaaaaagtgggtgagatggtgagacttaactaccctattmcaccactactaggatggtaagaatttagtaagtaaaccagaaagttattagaaaaacaagtaggagcaaaataagctctgtggcattgaactaagaataaaatgtgaagagaaggggtgagctctattatctacttagggatgccttcagtagaaaatgggacttaaaaatgggcaaaacttaggagggtctttccagga

SEQ ID NO: 478 - DNA, 401 bp, Homo sapiens
tacacctggatacaagggaacagtagacactgaggcctactggagggtgggaggaaggtgaggatcaaaaaactacctatcaaatactatgcttatcaactgggtgatgaaataatctgtacaccaaacccccataacatggaatttacctatataacaaacctgcacatgtatccctgaacccaaaataaagtttttttwaaaaaaaataagatcatctagacttgggtaggtggccattgtggacatcatacaagcagaagaagctgatctatggagaagacccataggacagtagtattgagaaagcatagagtcccagagagagacaatccagtttccacagccttgactaatattattgctttataattctgtaaaatttcctctgaagccttcca

SEQ ID NO: 479 - DNA, 401 bp, Homo sapiens
gaaataaaatgaagccacaatctcagtctatgaaaaagagataagttaggataaaactacagcaaaaaatgtacaggaaaagaatgctgctctttaggagagaaatcagaaaagtcagaagataaaatacagagcaaaaagtttactgatcccaacagagaaacaagaaacctcagagcacttatatgcaaagtatttgcrgtgttttggggcccactgactgtaagggaaaccaggtatacacagctttagggcacaatggagagaaagctcttgatatactctcctgagtctcataaacagcaacatcctccaacgtaaatgacagtgaaagaatatgatgaactcctgatgggtrgatgccacaggaggatccagccttatttttcctcagctctttc

SEQ ID NO: 480 - DNA, 401 bp, Homo sapiens
gagaaacaagaaacctcagagcacttatatgcaaagtatttgcrgtgttttggggcccactgactgtaagggaaaccaggtatacacagctttagggcacaatggagagaaagctcttgatatactctcctgagtctcataaacagcaacatcctccaacgtaaatgacagtgaaagaatatgatgaactcctgatgggtrgatgccacaggaggatccagccttatttttcctcagctctttcctcaaggaaaagactgggaattgataatactaaattgacaagtccaaataagccttcaggcaaagcagatgatccttttttttttttttttttaagtatccaaaccagtctcagatttcttcagccagaaagcatgtttttgcaggctttttacaaa

SEQ ID NO: 481 - DNA, 401 bp, Homo sapiens
aggttttgtttgtttgtttttcccaaaagaatttgatgcttgtgttttgaggagttaaaattctcaatgtaatagaagactctataataaacttacgtcttcttagggtgatacgaaaattattaaactcaatccccctttagttgcaaacaatcaatactcaataatttttttgaattgatgaacctctgattgtgtgcractatcttaattatgtctatattcttggtcttgtgatgaaaagtatccagaaaatgtctactattcatcactgtatgccttcttctttttagcacagagctttgtacatacgaagttctcaactaatgtctgttaatttaaattgaagaagctttagggagttactacaatttaggtctggaactcacatcccattttcc

SEQ ID NO: 482 - DNA, 401 bp, Homo sapiens
tatgagttgagtaaccatgatatgctagtatcttttcaaatatataattttttgattatataaagataaggttgatcttcatctcagacaattttccagcctagtagaaacaataaacacagttggattgtaacccaaacttcaactgtaggtcatctcacctaagttagtggatatttggtataatgtttagtaaaaagytacactttgtggcccttcatcatagcaaatattggctttattggcctttaatatcccaaataagaattatcaagaaaataggctccattttcattattaagtatttcagagaaataaaacaataatactgccttaccattgtaggtcattttatagtttccaagggttttcaactatatctttttttaaaaatttgaact

SEQ ID NO: 483 - DNA, 401 bp, Homo sapiens
aaacagacctgtggctaacaaaggattgtgggtggcagttgcttttagaaaccttggtgaaacttttcaaaagaatgtttcctatcaagcggtgcgttgtacatgtgggagaatccctgacagcacgttgctcttcctggagctccgtgagcatttattcccagtaatgtcctttggtgcttctttccttcatcccttaaygaacctaatccactctagccactcttcgtgatgtgaggtcaagagggtgaacayggcagatgtggcatttatgcgattacattctggtggaagaaaatgggccattaaaatgcaaaccaaaaatcaatgatctgattaattgcagattgtgataactgtaagaaagaaacagagtgccctgataaaaattaagtacgctg

SEQ ID NO: 484 - DNA, 401 bp, Homo sapiens
tggtgaaacttttcaaaagaatgtttcctatcaagcggtgcgttgtacatgtgggagaatccctgacagcacgttgctcttcctggagctccgtgagcatttattcccagtaatgtcctttggtgcttctttccttcatcccttaaygaacctaatccactctagccactcttcgtgatgtgaggtcaagagggtgaacayggcagatgtggcatttatgcgattacattctggtggaagaaaatgggccattaaaatgcaaaccaaaaatcaatgatctgattaattgcagattgtgataactgtaagaaagaaacagagtgccctgataaaaattaagtacgctgacttatttccatagggtttctgagaagatcttcactctggggaracaatattta

SEQ ID NO: 485 - DNA, 401 bp, Homo sapiens
agggtgaacayggcagatgtggcatttatgcgattacattctggtggaagaaaatgggccattaaaatgcaaaccaaaaatcaatgatctgattaattgcagattgtgataactgtaagaaagaaacagagtgccctgataaaaattaagtacgctgacttatttccatagggtttctgagaagatcttcactctggggaracaatatttaagctgcgagctaaaggatgacgatgacacataggaaagaatgttccaggctacaagaccaatcagaacagaagccatgaggcgggaagaagctacatgtctctaacttctagtcagtatgaccagagtgtagattgagacagacatgcagcatagaatggaatgagatgaaaatggagacagaggcggga

SEQ ID NO: 486 - DNA, 401 bp, Homo sapiens
cgctgatgtgtttatgattgataactgttttttgtcagctttttaattttagctgcaccatcttactttttggtacagatctatttactatctaggagttgtgggggacttggtgggtagccagaaaagatgacagctagcagagcttaggcacaggagcagatgtaagtgcaggtggctggcagtgtggggaccctggargcagctgctctcagggtaaaatccacgggaggactaggcagggtgagagagcatccccaggcaaagtagagtgacctgcctctgagagtttgggtgtagaatgcagcaggatgactcagaaaagtctgcagagctttagaaawgcttttttttttttttttttttttgatgtggtgtaaggttagaagactagaatgacg

SEQ ID NO: 487 - DNA, 401 bp, Homo sapiens
agcttaggcacaggagcagatgtaagtgcaggtggctggcagtgtggggaccctggargcagctgctctcagggtaaaatccacgggaggactaggcagggtgagagagcatccccaggcaaagtagagtgacctgcctctgagagtttgggtgtagaatgcagcaggatgactcagaaaagtctgcagagctttagaaawgcttttttttttttttttttttttgatgtggtgtaaggttagaagactagaatgacgtttgtctattattcaggagatgttctttgtaggagaaagaaagggaaaaagaaaaagattccaaatattttagtgggcattatgtagttccgtctcttgctccttcccttaattccccctccagaggggaaacagatatctgt

SEQ ID NO: 488 - DNA, 401 bp, Homo sapiens
tttagtgggcattatgtagttccgtctcttgctccttcccttaattccccctccagaggggaaacagatatctgtgaaactgaaaagcttgcatctttgtgagatctgctggagggaagctaccgtttaaacccagtctccattattttaaatggttttaagcctcacatgtagtgctatttatttttccttctaaaaaayatttctgggttatgcctccatatacaaaactcacctttgtgccattgtgctgttttgatgataggtaatttagctagatttagctaccatctattgagcacttaaaattaatctctgtaataaactctattcaggcatttcatcatttaatttaatacaaaccctgtagaaagtggatatcactcctcttttgctaattg

SEQ ID NO: 489 - DNA, 401 bp, Homo sapiens
ggttaaacagaagttacagtctgtgttaccaagggcctcgtagattactggagaagacaaagatgcaaataggcaattataataaaaaatgctacacagacagacaggaatatattcaagtcactcttaggcgcttctcctcccaaaacttaatcccccacttccattacgccatggtgccttccagaattagcgcagttygcatactgaaggaaactgaggggtggtcagaaacccagtttgtgcaggaaaaaaaattgtggagawcaaaattagcttcagtttttaatatcagccattaattctgaggaacaacttcatccacttaacttgattttccatcttccttgagtcccaaggcaaaactgaaatggaaaagaatctacaggatgctttcattt

SEQ ID NO: 490 - DNA, 401 bp, Homo sapiens
aaataggcaattataataaaaaatgctacacagacagacaggaatatattcaagtcactcttaggcgcttctcctcccaaaacttaatcccccacttccattacgccatggtgccttccagaattagcgcagttygcatactgaaggaaactgaggggtggtcagaaacccagtttgtgcaggaaaaaaaattgtggagawcaaaattagcttcagtttttaatatcagccattaattctgaggaacaacttcatccacttaacttgattttccatcttccttgagtcccaaggcaaaactgaaatggaaaagaatctacaggatgctttcatttagcaaagaggcaaacaaacccaaatcgagcagtacatcatagcaacccactaattggaagtctggg

SEQ ID NO: 491 - DNA, 401 bp, Homo sapiens
aatgaacttgttttattgcttatcatatggtccaattttgttaaacattcaatttgccctgggaagtaacatgcattttgcttattttaaaagcagtgcattataaatgcaaattaaggcatttatatataatgacatatatatgtgtgtgtgtgtgtatacatatatatgtatacatatatttgcttttgacttgtttcmtcagctactgggagaggtatgtcaaaatctcaaactttggttgtgaatgtactattctttataaaatttaaaactgtgttattaggtctataaacattaagaatgtttgtatatttttggtgtaatgacccttttatcagtatttttttcatatttatctctagaaatgctttgaagcctaatttgttattaatatatca

SEQ ID NO: 492 - DNA, 401 bp, Homo sapiens
ccacttgtatccctaaagctattgaaataaaaaaaatcacaaagtgctgttgcctactccacagccatgcaagtttgattctggatctgagacaagctatgatcacattgttgtagagaactgaggtccttggaaaataaaacacaggttcccaaccagaagttaattttattctgctgttaaaatggaactatgactttkcttatttataagaactgtccttcctttttaaggttaaaacatgttattttattataatgcaaataatattcattatttaaaaatagaaaaataagaggcagatgtagttctagctcttaataaacctggctaaacttttacaaatttcatctgatcatttatatacttttctacatgattggacttatttataatttgga

SEQ ID NO: 493 - DNA, 401 bp, Homo sapiens
tatcctttcactacctttgataacacactaaatttttctttactatatttcattcccttcttaatctcatttctaaaaactgtatttctgtcttacaatatatatatcattccttcagtactcctacctgttgatcttctcattgttatttactggcttgtcaggtcttggaagataggcttctcatacaacccaagcctstcttttgacctgactataaatattttattgtttacatcttcccctgcaaagaattcctctaggatctgcccctttcttgttctccaggcagtatgccttggacattctgtagctggctgggactgattccttgccaggtcagtaggacagatgtgtagactaagaaattaactagtgagttcaagtggaggttcctggcc

SEQ ID NO: 494 - DNA, 401 bp, Homo sapiens
aaaagaggaactaaaaaaaggctgagaaagcatgccatgaaggtccaggcttggacaacaagcataccatgatgtgaattttagccccatcacctactaactgtgtgaccttgggcaagcttttgaactcaccagggcctcaatttcctaacctataaaatttttgtgatcattattataattacaactaagaataagtaycttatcrttttgctgcaatacacgcgtgataattgtcctaaagtgcttagcatggtgtctagaacgyattatgtacttaataattattgtctgaaaaaataaacacatgaagaaaataccttattgtcaaagaatataatactgtgccccaacttgtgaaagattaaacctcttgtgtctccaggatttctaatagctta

SEQ ID NO: 495 - DNA, 401 bp, Homo sapiens
gaactaaaaaaaggctgagaaagcatgccatgaaggtccaggcttggacaacaagcataccatgatgtgaattttagccccatcacctactaactgtgtgaccttgggcaagcttttgaactcaccagggcctcaatttcctaacctataaaatttttgtgatcattattataattacaactaagaataagtaycttatcrttttgctgcaatacacgcgtgataattgtcctaaagtgcttagcatggtgtctagaacgyattatgtacttaataattattgtctgaaaaaataaacacatgaagaaaataccttattgtcaaagaatataatactgtgccccaacttgtgaaagattaaacctcttgtgtctccaggatttctaatagcttatcccaga

SEQ ID NO: 496 - DNA, 401 bp, Homo sapiens
catgatgtgaattttagccccatcacctactaactgtgtgaccttgggcaagcttttgaactcaccagggcctcaatttcctaacctataaaatttttgtgatcattattataattacaactaagaataagtaycttatcrttttgctgcaatacacgcgtgataattgtcctaaagtgcttagcatggtgtctagaacgyattatgtacttaataattattgtctgaaaaaataaacacatgaagaaaataccttattgtcaaagaatataatactgtgccccaacttgtgaaagattaaacctcttgtgtctccaggatttctaatagcttatcccagaaaggcagtgcagaggacatgtgggctctcttcctactgcagactcrggctrttctgatgg

SEQ ID NO: 497 - DNA, 401 bp, Homo sapiens
tggtgtctagaacgyattatgtacttaataattattgtctgaaaaaataaacacatgaagaaaataccttattgtcaaagaatataatactgtgccccaacttgtgaaagattaaacctcttgtgtctccaggatttctaatagcttatcccagaaaggcagtgcagaggacatgtgggctctcttcctactgcagactcrggctrttctgatggtggggtccaagggcagccttgcttctgccatttgctcagttgatcttgtgaacagctgcggttcttgctgtaactacttgctcgctctcagtgactctgtactgtaaatgtttcatgtgaagragcactgctctaaaacaaagctggaaracagggaggcaattgccagagctgtcattgtgctga

SEQ ID NO: 498 - DNA, 401 bp, Homo sapiens
tctagaacgyattatgtacttaataattattgtctgaaaaaataaacacatgaagaaaataccttattgtcaaagaatataatactgtgccccaacttgtgaaagattaaacctcttgtgtctccaggatttctaatagcttatcccagaaaggcagtgcagaggacatgtgggctctcttcctactgcagactcrggctrttctgatggtggggtccaagggcagccttgcttctgccatttgctcagttgatcttgtgaacagctgcggttcttgctgtaactacttgctcgctctcagtgactctgtactgtaaatgtttcatgtgaagragcactgctctaaaacaaagctggaaracagggaggcaattgccagagctgtcattgtgctgagtcag

SEQ ID NO: 499 - DNA, 401 bp, Homo sapiens
ctaatagcttatcccagaaaggcagtgcagaggacatgtgggctctcttcctactgcagactcrggctrttctgatggtggggtccaagggcagccttgcttctgccatttgctcagttgatcttgtgaacagctgcggttcttgctgtaactacttgctcgctctcagtgactctgtactgtaaatgtttcatgtgaagragcactgctctaaaacaaagctggaaracagggaggcaattgccagagctgtcattgtgctgagtcagggaaggcttcagcaatcatccaaagagatgtggcatttacacctgcagctggatgggttatgaacccaaataggtccttaaaaaggaaggctcatctcctttccccccaacagccccccacccactcaattt

SEQ ID NO: 500 - DNA, 401 bp, Homo sapiens
cagaggacatgtgggctctcttcctactgcagactcrggctrttctgatggtggggtccaagggcagccttgcttctgccatttgctcagttgatcttgtgaacagctgcggttcttgctgtaactacttgctcgctctcagtgactctgtactgtaaatgtttcatgtgaagragcactgctctaaaacaaagctggaaracagggaggcaattgccagagctgtcattgtgctgagtcagggaaggcttcagcaatcatccaaagagatgtggcatttacacctgcagctggatgggttatgaacccaaataggtccttaaaaaggaaggctcatctcctttccccccaacagccccccacccactcaatttttgcctactttaagggaaggtttttgg

SEQ ID NO: 501 - DNA, 401 bp, Homo sapiens
cattgtgctgagtcagggaaggcttcagcaatcatccaaagagatgtggcatttacacctgcagctggatgggttatgaacccaaataggtccttaaaaaggaaggctcatctcctttccccccaacagccccccacccactcaatttttgcctactttaagggaaggtttttggtaactaatttttcatctgctcattaragcttaccaattacagcatgtgttacaaattataggttccaggactttgggtgaaatrtgcttcgtaaataatggcatattttgctgtgagcagtccttgattttggactcttgcattacctttcatctcgcaaattttccgtataggaatacttggatgtacaaatttcaggcaagtatccgatgtatcttatagaatc

SEQ ID NO: 502 - DNA, 401 bp, Homo sapiens
ctgcagctggatgggttatgaacccaaataggtccttaaaaaggaaggctcatctcctttccccccaacagccccccacccactcaatttttgcctactttaagggaaggtttttggtaactaatttttcatctgctcattaragcttaccaattacagcatgtgttacaaattataggttccaggactttgggtgaaatrtgcttcgtaaataatggcatattttgctgtgagcagtccttgattttggactcttgcattacctttcatctcgcaaattttccgtataggaatacttggatgtacaaatttcaggcaagtatccgatgtatcttatagaatcagctacccgacaatattgtcaaaaagagaagcaacgctttcagatgatgtaagcatag

SEQ ID NO: 503 - DNA, 401 bp, Homo sapiens
tcacttttcacatgaaagtgtatgctcagataaaacaagactcatggagagcacatgggtgagatcatgctaggctctcattgctaggctgagatttgcatttttctgaaaatcagagtgctgaattttcttagctttgaagtagctaatgggacagtgtgtgtatatgtgtgtgtgcccacttgcatataattccgaatyacttgtttatgtgtagtatatgattctatgacaaagagctccctttaatgcaaatrtaaggcattcatgagcatctcatgtataagctcatattttgaactttgtttttcttttactcaaagaatttacaaaatcattttgtggtttgaaaagtaattcagatttcctataaaatgttatataaaattttaaatttagat

SEQ ID NO: 504 - DNA, 401 bp, Homo sapiens
gggtgagatcatgctaggctctcattgctaggctgagatttgcatttttctgaaaatcagagtgctgaattttcttagctttgaagtagctaatgggacagtgtgtgtatatgtgtgtgtgcccacttgcatataattccgaatyacttgtttatgtgtagtatatgattctatgacaaagagctccctttaatgcaaatrtaaggcattcatgagcatctcatgtataagctcatattttgaactttgtttttcttttactcaaagaatttacaaaatcattttgtggtttgaaaagtaattcagatttcctataaaatgttatataaaattttaaatttagattttagctagcaagtattggcttaactgtagaaagaacttcattttctaggaccatt

SEQ ID NO: 505 - DNA, 401 bp, Homo sapiens
aagctagaaagtctaggaactaagattcagaacaaaatcatctgattccactctctgtgctcttaaatacttcactagaataagtcttattttttataattgatacaactggtctaaatattaatgaagttttaagattcaatttacatatagcttctgtctctgtaagttaccagttattactacctaaaatacacttgkagtcaatagtaacattgaatattcctagattttattttwtaataccaaccagaataggaggcctcaaaayacctgtgatggaaaaaatgcagtgcctgagtgcatgcagctaagcctgatcactagaatacatttcatttatattttataagataccaaagacttcagaactacaaagagaactatagttgctgcaacca

SEQ ID NO: 506 - DNA, 401 bp, Homo sapiens
atctgattccactctctgtgctcttaaatacttcactagaataagtcttattttttataattgatacaactggtctaaatattaatgaagttttaagattcaatttacatatagcttctgtctctgtaagttaccagttattactacctaaaatacacttgkagtcaatagtaacattgaatattcctagattttattttwtaataccaaccagaataggaggcctcaaaayacctgtgatggaaaaaatgcagtgcctgagtgcatgcagctaagcctgatcactagaatacatttcatttatattttataagataccaaagacttcagaactacaaagagaactatagttgctgcaaccagaaacctattcacatatacgtacttttataaatcatgtg

SEQ ID NO: 507 - DNA, 401 bp, Homo sapiens
ttcactagaataagtcttattttttataattgatacaactggtctaaatattaatgaagttttaagattcaatttacatatagcttctgtctctgtaagttaccagttattactacctaaaatacacttgkagtcaatagtaacattgaatattcctagattttattttwtaataccaaccagaataggaggcctcaaaayacctgtgatggaaaaaatgcagtgcctgagtgcatgcagctaagcctgatcactagaatacatttcatttatattttataagataccaaagacttcagaactacaaagagaactatagttgctgcaaccagaaacctattcacatatacgtacttttataaatcatgtgcatatgtgtgtgggtacctycatgtgtgtgc

SEQ ID NO: 508 - DNA, 401 bp, Homo sapiens
aggcctcaaaayacctgtgatggaaaaaatgcagtgcctgagtgcatgcagctaagcctgatcactagaatacatttcatttatattttataagataccaaagacttcagaactacaaagagaactatagttgctgcaaccagaaacctattcacatatacgtacttttataaatcatgtgcatatgtgtgtgggtacctycatgtgtgtgcatatataaatacatctaaaagctgagaaccaccttagtctggggcattaaaattttagtaaacttttttgatgtatatgttgaataagttgcaaagttgaagtctgttccctgcctccatgtggcttacgtacacttgctaatgagaaaggagcttattacaaatattcatagatgtgatatatatgtg

SEQ ID NO: 509 - DNA, 401 bp, Homo sapiens
atattcatagatgtgatatatatgtgtacatgtgtgtatatatatgtgtgtgtatatatacatatatatgtgtgtgtatatatacatatatatatctttctccccctacacacacatacacacacccctttattcgctctcttttttttttttttttttttttttttagttggagtctcactcttgttacccaggctagartgcaatggtgcaatcttggctcactgcaacctctacctcccgggttcaagcgattcccctgcctcagcctcccaagtagctgggattactttctactatacaaattttactgtcatagacattggcttttgtacctccaaaatgtttgttattatccacggaaagggtacccacattttacttctatggataaattacac

SEQ ID NO: 510 - DNA, 401 bp, Homo sapiens
agcacttaaaatgctgcctggcacatgtagagactcagaatatgctttcagaattgaatgaaaatatcttgacaaggtagcacagtttttgcttttgtttttgttttaatagagtcagggtattgctctgtcaccccacccaggctggagtgcagtggtatgatacagctgactgcagcctcgaactcctgggctcaagcratcctcctgcctcggcctcctgagtagccagtaccacaggtgtgtgccaccacgcccagctaagtttttattttttgtattttttttgtttttttgagatagggtcttcctcagtcttcaggtacaatctcagctcactgcaacctcaacctcctgggctcaagtaatcctcctgcctcagcctcccaagtagctaggac

SEQ ID NO: 511 - DNA, 401 bp, Homo sapiens
tctcaaactcctgtgttcaagtggtcctcccgcctcagcctcccaaagtactaggattacaggtgtgagctaccacacccagcctaatattttattttttgtagacacagggtccccttatgttgcccaggctggtctcaaactcctgtgttcaagtggtcctcccgcctcagcctcccaaaaggttgggattacaggtgygacccactgtgtcagcctctcattgttttccatctgacaggtgagaaactgaacctcagagagcatggattactgacccagtatcacagctagtgcagtgcagaagcaggagtggaacctccatttggctccactggccagactccctatctgtgactctgtctccaagaagctcttcgaggccagacagcagcatcttc

SEQ ID NO: 512 - DNA, 401 bp, Homo sapiens
ctggggtcttttaggtcacaagtatccctggtcttttcatgactacacatttctggctgactttagagctctagatgtttttctcctatgttgatctaccccgtaaggctccatgagaggcttggactattgtttcacagtaggcttcctaagacattttgcttagctccttgaaggcttccacctgctcttgagcttagraggagaatatggcctagtcaaagagagaagagcataatagcagataggagtaagtgagcaggaaacacagagaaatggtgaagaggaggaaagaatggccaatagaagatggaaaggcagcagtcacggtcacaaaaaaagggtccagaaacaatacaggagatgcacaagagatttcattgcttttaagaagtgttatg

SEQ ID NO: 513 - DNA, 401 bp, Homo sapiens
ttacatatgtaagataaatttaagatttgtgtttaaatgacttttaaaagtaaaaaaagcattgggaagacttcttactcagaggttgtggtcagtcattttcaaataatttttcattgccaacatctcatacataaacttatataagcttctacaacccctcccagagtcagccttctctcttctttcagtaacatcctrtgttgccatctgactgaactgcaccatttgtcaccagttccaacacatcttgtcaacataccttttctattggaagaaaaaaagaaaatgggcttgaataaaaacatgtaaataaatgatgagcactttgctcttttggttgaattaaacagtgttgaaaggtgttagctagagaagacttaatagaaagtataacattt

SEQ ID NO: 514 - DNA, 401 bp, Homo sapiens
caccagttccaacacatcttgtcaacataccttttctattggaagaaaaaaagaaaatgggcttgaataaaaacatgtaaataaatgatgagcactttgctcttttggttgaattaaacagtgttgaaaggtgttagctagagaagacttaatagaaagtataacattttaaataatgtttaaggggaaaaagaaaaagayattttaggtttcagaataaataaaagataaaaataaataataaaagattttaagtattagggatgacttgcaaaatctcagaggtaaaggtaagaaacactagacagaaaataattttatttgaatttaaaaaatgggagagaatccacagaccctttgagggaactggatcatctttgcagactccctgagatgtcgaa

SEQ ID NO: 515 - DNA, 401 bp, Homo sapiens
agcaaaaacaatccctacaattcatctctcagaaagccccattcctaggagaagggggagaacaccacatcaagggggcacctcatgggacaaaagaatctgaacagcagttcttgaatcccagatcttccctctgacatagtctacctgaatgagatgggaccagaaaaacaattctggtagtatgacaaaataaggttrtttaacaccccccaaaaatcataccagctcaccagcaatggatccaaaccaagatgaaatctgaattgccagaaaaaagaaaaattggaaggttggttattaagctcatcaaggaggcaccagaaaaaggtgaagtccaacttaaagaagttgaaaacgtgatacaggatatgaaaggaaaaatcttcagtgaaataaag

SEQ ID NO: 516 - DNA, 401 bp, Homo sapiens
gagaaatgcaaaatgcactggaaagtctcagccatagaatcaaacaggcagaagaaagaacttctgagctcgaagacaaggcatttgaattaactcagtccatcaaagacaaagagaaaagaattttaaaaaaatgaacaaaggctccaagaagtttgggactatgttaaatgtcccaacctaagaataactagtgttccygaggaagaagagaaatctaaaagtttggaaagcatatttgagggaataattgaggaagatatccccggccttgctaaagatctagacattcaaatacaagaagctcaaagaacacctgggaaactcatcgcaaaaagatcattggcttggcacacagtcatcaggttatctaaagtcaagatgaaggaaagaatcttaag

SEQ ID NO: 517 - DNA, 401 bp, Homo sapiens
gcatatttgagggaataattgaggaagatatccccggccttgctaaagatctagacattcaaatacaagaagctcaaagaacacctgggaaactcatcgcaaaaagatcattggcttggcacacagtcatcaggttatctaaagtcaagatgaaggaaagaatcttaagagctctgaggcaaaagcgtcaggtaacctatraagaaatatctatcaggttaacagatttctaagcagaaaccctacaagttagaagagattggggtcctattcttagcctctttaaacaaaacaattattagccaagaattttgtattcagcaaaactaagcttcgtaaatgaaggaaagatacagtgtctaccaggcacacaaatgatgagagaattcaccattaccaag

SEQ ID NO: 518 - DNA, 401 bp, Homo sapiens
ctaacactggagcacccaaatttataaaataatcactactagacctaagaaatgagatagacagcaacacaatagtagtgggggacttcagtactcccctgacagcactaaactggtcatcaagacagaaagtcaacaaactctagcctgcaacaaatgaacttaaaagatatttatagaacattctacccaacaactgcmgagtatacattctactcatcagcacatggaacattgtccaagatagaccatatgataggccacaaaacaagtctgagcaaatttaagaacattgaaattacatcaagtactctctcagactacagtggaataaaattgcaaatcaactcctaaaggcatccccaaaccatacaaatacatgcaaattaaataacttgctc

SEQ ID NO: 519 - DNA, 401 bp, Homo sapiens
caataaatgtgatacaccacttaaacagaattacaaccagaaatcacatgattgtctcaatagacacagaaaaaccatttgacaaaatccaatctccctttgtgactaaaaacctcagcaaaatctgcatagaagggtcataccttaaggtaataaaaaccatctatggcaagcccacagccaactttatactgaagaggraaaagtggaaagcattcccactaagaactggaacaaggatgcccactttcaccacttctattcaacatcgtaccaggaatcttagccagagcaatcagacaagacaaagaaattaagagcatccaaaatggtaaagaagacatcaaattgttgctgtttgcagatgatatgatggtatacctagaaaccctaaagtttcc

SEQ ID NO: 520 - DNA, 401 bp, Homo sapiens
cagatgatatgatggtatacctagaaaccctaaagtttccaccaaaaagctcctagaactggtaaatgaattcagcaaagtttcaggatacaaaattaatgtaaaaaattagtagctctgctatacactaacagcaaccaagctgagaatcaaatcaagaactcaacccctttcacaatatcagcaaaaaaataaaatacrtaggaatatacctaaacaaggatgtgaaagacctctacaaggaaaactacaaaacactgctgaaagaaatcatagacaacacaaacaaatggaaacacatcccatgctcatggatgggtgaattaatattgtgaaaatgaccatactgccaaaagcaatctacatattcaatgcaattcccttcaaaataccatcatcac

SEQ ID NO: 521 - DNA, 401 bp, Homo sapiens
gtgaattaatattgtgaaaatgaccatactgccaaaagcaatctacatattcaatgcaattcccttcaaaataccatcatcactcttcacataactagacaaaacaatcctaaaattcatatggaacaaaaaaagagcctgcatagacaaagcaagactaagccaaagaacaaatctgaaggcatcacattatctaacatsaaactatattataaggcaatagtcaccaaaacagcatggtactggtataaaaataggtgcatagaccaatggaacagaatagagaacccagaaataaacccaaatacttacagcccactgatattcaccaaagcaaacaaaaacaaagtggggaaaggacaccctattcaacaaatggtgctgagatcattggcaagcca

SEQ ID NO: 522 - DNA, 401 bp, Homo sapiens
aatgaaactggatcttcatctcttatcctatgcaaaaatcaactcaagatggatcatatacttaaatctaagatgtgaaaccataaagattttagaagataacatcagaaaaacccttctagacattgacttaggcaaagacttaaatgaccaagaacccaaaagtaaatgcaacaaaaacaaagagaaatagatgggaaytaatgaaactaaaaagtttctgcacagcaaaaaaaataatcagcagagttaacagacaatccacagagtaggagaaaatcttcacaatctatacatctgacaaaggactaatatccagaatctacaaagaattgaagcaaattagcaagataaagacaaacaatctcatcaaaaagtgggctaaagacatgaatagacaa

SEQ ID NO: 523 - DNA, 401 bp, Homo sapiens
tttctcacagtttgatttcaatcctctcacattttgtgaggtggctgtttataccaatctgtggcctaagatattcttatgactattacttgtttatcaaaatggtacacattcttcagttgcagctccacaggctttctggaactactgtaattaacattgatttctttatctctttccttatttgtcatgtatgattakcactacatagaatgacatttactttttctcctttttcttttatatgtgctaattctgtctctttagcctagtcagaagctctgagttcgcagaataaccatgaacacagaattaaaggtctagatagatcttgtctaaccctttcattttcaaagaaggaaagtttgtaaaatggaaactacagtgatattgagtgtata

SEQ ID NO: 524 - DNA, 401 bp, Homo sapiens
agagcaagtaataatgttatactgagtgattaatgaactgatgtaaggactcagtaatccgcatgcaattagtggatcaacaaagcaatttacgcagtaggtatgtattttgaatagtattctttctgtagggaaccagctgtatgtagtgtttaattgaatgcttttgcatcacagagtgatttggagtcaaatcatcarccgcatttcccaatgtgtcaagtagacagttaacttatcaaaacttccgtagtactcagttctcttccaatgtgctccttatcttgaattcttttgaaatagtgtgccttataattttccaggaatgatttacatgtattcctgttcagagacagagggatggattacataacattccctgaggccctttttgccttcga

SEQ ID NO: 525 - DNA, 401 bp, Homo sapiens
cattcattttcccctggtgaataagctggccctttcccaacctgactctcatcttgttatttgatcccaagatctgtaactcctctcagaccatctgcattatttctctgtccttgctgatgttttgcaacattctccagctgactatcatctgcagatttcattagcacaccatttactatgttctgaagatcattaatraagatgaataaacagaagagaagaccttctgcagacatctgtggaatttctctgggctgcccccacaactcgatcgccattgttttattttacctttttggttttttgcctagtgtttcattcacttccctccataagcaccctgttgtcatatctgagtaactgcactcataatgtgtgattttcttgcacagctttat

SEQ ID NO: 526 - DNA, 401 bp, Homo sapiens
atgaagatttatatctaacttatattgaaaaatcaaaggattagattttttaaactgaataagaaccatagctgtacttagagaatatctgtgatgcacttggcactgtgataagatgtgatgtatatcactatgattacaccaaccctgaatggcacttattttcaggtgtgacactagcctatggcggctgtcatgagrattagaaaatggtgtcccctccaggaggatactgcctgtgcctgagaatagagcacaggctgcatctaaggacccactgaccttctaggccagatatctttgtgtgtggcagagcctgcctaaatgtacatggaagccacgatttctttgtcatttaaatgaagaggataagatacctataaaagatagatttgagattg

SEQ ID NO: 527 - DNA, 401 bp, Homo sapiens
ctacttgggatgctgaggcaggagaatcacttgagcccaagaggcaaagttgcagtgagccaagatcatgccactgcgctccagcttgggctacagagtgagactccatctcaaaaaaaaaaaaaaaaaaaaaaaaaaaaaactactacttatcaaggaatgttttgaatgctttaattctttgacttaaattactatatwtatttataaaggtgtagaagatttracaactggaatgtgtgtgtgcgcatgcacatatacacacatatgcacatatgtatatatgtgtatgtataacatatatatctataaataaaagttatttaccaaagcatcatatattttcattttcttttctttccttttgttagcattttcatttttcttgagtactgttttta

SEQ ID NO: 528 - DNA, 401 bp, Homo sapiens
atcacttgagcccaagaggcaaagttgcagtgagccaagatcatgccactgcgctccagcttgggctacagagtgagactccatctcaaaaaaaaaaaaaaaaaaaaaaaaaaaaaactactacttatcaaggaatgttttgaatgctttaattctttgacttaaattactatatwtatttataaaggtgtagaagatttracaactggaatgtgtgtgtgcgcatgcacatatacacacatatgcacatatgtatatatgtgtatgtataacatatatatctataaataaaagttatttaccaaagcatcatatattttcattttcttttctttccttttgttagcattttcatttttcttgagtactgtttttattgaaatgcaccttgcactttagct

SEQ ID NO: 529 - DNA, 401 bp, Homo sapiens
agctggaacagttcaataagagtctccctctagcctctccttacttctgaataagcaaagttaagctacagtcaactagtcggcttctctaatattctgtattgttctgaggtttaaggctttgtttttttcttggctgtctaggctctctgattaactgagattaatctctatcatcctgtgtaagctaaaccctaaatyacataatatgttttctatctgtatgccatatgccttccatgtcagggatgactccagagacaacaaaagcaagctgtgtttttactgattttgcaaacttgcattcatcagccttgggcattttggcctccccagtgtcagtatggtgttttaatagctgagaaaaacaacagaaatataaagagaggacactgtgaaaa

SEQ ID NO: 530 - DNA, 401 bp, Homo sapiens
aacaacagaaatataaagagaggacactgtgaaaatcactttccaaactgacttgtattgaaactgcctcacatctaagtaatggaaaataacagtgattaggataatgcggtgcattacattcggtgacagttaatcctcttattaacttcatggtcatatttcgctcatttgttaggttggaaggactgtgtgagaatrttgtagttcctgtttttctgttcattgggaaagttgggaaaatagttctaaaaataaaagagttccaggttgaaaagcctttgaggttgactgttctctctggagatgcatgtttaccttgtgccctttatccatgctttgagtttgggtacccactctttgaggcctcattctcttccctttagaggattttctttcca

SEQ ID NO: 531 - DNA, 401 bp, Homo sapiens
taaaaataaaagagttccaggttgaaaagcctttgaggttgactgttctctctggagatgcatgtttaccttgtgccctttatccatgctttgagtttgggtacccactctttgaggcctcattctcttccctttagaggattttctttccacctgagcaatcaccagtgagggaaaagtcagtggggtggttcagctgcrtgatatgttgcattgacaaatggaggcagagccctgctccagccccgtgagttggaacaacctacaaagcatttctggcagtgagccaaagaggtgatccctcctctagggaaaaaaaaagtcaatggctgagattgcagttctccatccccttgctgggctgattcatacagcagcattgacactgaggtctcagaaga

SEQ ID NO: 532 - DNA, 401 bp, Homo sapiens
ccctcctctagggaaaaaaaaagtcaatggctgagattgcagttctccatccccttgctgggctgattcatacagcagcattgacactgaggtctcagaagaactgttctcttcccagtccatctaaaaatatctaaattcagatttataatgtcaggagctgataaatttgctgaggaaatgcaagcagtgtcactgccrtgctaggaaatctattctgatgaattgatgagggaaagaaattccaaacatagcagagtctcagagtgccacttcccctgggatggtgagcaaaatgagcatgttttccttgccatcgaagttcccttcttcaaacatagtagaaagtagaatatactagattgaaaaggaatatggaaaatacctttttgatcaaaagc

SEQ ID NO: 533 - DNA, 401 bp, Homo sapiens
cgtcaagcaaggggttcccttttaaaatgctctttcactaagacaaaaattccactcacatagccctggtgacttttgattgaatcaggatcttttaaatttggaactcagcaagaaaccgactgtcttactttcctacaggttttgtttgaactttcagaatctaagttgatattgcggtctgctgctaaccagctcttycctctctttagttggtcagtggattctcaggagtattataggatgtttcctccataccacctggcttgaaatgatttggcataggcttcaactctaatttattcagcatccctttagcgcctactagaaaccaagtatcatgactggaacttttctgaaatgatgaaggtgccatggggacagatgggcgtgtaaagaac

SEQ ID NO: 534 - DNA, 401 bp, Homo sapiens
taagaaatagatctactgaaactaataaaagaattccattgttgtctcctccatttaaaaaaattctacctgaaatacttgttagaatttttataaaagtagtatctcatttatgtacaaaatagtttgtgtaaactataagtagacaaagatgtagggttgtatcacttctttgataagatactgatcttgtatttttamccaatgctaggcttaataaaagggtcctgtaaaatttactatgaaatctgtatgcctccctccaacttcttttccaactgagattggagtatggcaaaggaaatgaagcatgaagggaaaactaggagctatgataatctaagattcataaacaattataacattatttgctcacttttgattgtgcaaatgactaaatc

SEQ ID NO: 535 - DNA, 401 bp, Homo sapiens
gcccacatggccacaggatcagagcaggtcatggtgaagcagaggagaaacagctgcaaagcagagaagaaagtccaatagggtaggatgtgatgaataatgttgtgaaacagacagctagtgccagtaaggctcctatatcatagaagtctaggaagatacaagcaagtgctgtcatagacagataaatgaagtggacaytgttttgagacaaaagcaagctggcaatatcagagaagcttactataaagagcaaaatgctgggtgcactggctcatgcctgtaattccagcagtttgggaggccaaggcaggaagattacttgagctcaggagttctagaccagcctggtgagacctttatctctacaaaaataaaattaaaaactacctgggcatgat

SEQ ID NO: 536 - DNA, 401 bp, Homo sapiens
acacatttgaataaagcagcatgacagtgggacaaaaagtacacaagacaaaagctccatcgttagggccaaagcataggaacaaactcaggccagtgatggagcaacttcagctgagattttagccaagagcttgttaacatctttccagttcccagatagaattagtcctaaggaattacgaacattgtattccatggyatatatatatatactacattttctttatcctctaatcaactggtgatggacactgaggttggtttcatatacaagagcagatgtcttttatttttttttttttgagacagagtctcactctgtcacccaggctgaagtgcagtggtgtgatctcagctcacggcaatgtctgcctcctaggttcaagcgattctcctgcc

SEQ ID NO: 537 - DNA, 401 bp, Homo sapiens
atttttagttccttgagatatcttcatactgttttctatacgggttgaaccaatccatattcccaacagtgtataaatgttctcttttctccacatcaacatctgttgttttttgactttttaataatagctattctgactggtataagaggtatctcatgtggctttaaattgcatttccatgaaaaagaatgaaatcaygtcctttgcagcaacatggatggagctgggaaccattatcctatgtgaaataattaagaagcagaaaatcaaatatctcatgtattcatttataagtgggagctaaacaatgagcacatatgcacataaagatggaaataatagatactggagacaacaaaaatggggagrgagagaaagctgaggattgaaagatgatc

SEQ ID NO: 538 - DNA, 401 bp, Homo sapiens
ttgcatttccatgaaaaagaatgaaatcaygtcctttgcagcaacatggatggagctgggaaccattatcctatgtgaaataattaagaagcagaaaatcaaatatctcatgtattcatttataagtgggagctaaacaatgagcacatatgcacataaagatggaaataatagatactggagacaacaaaaatggggagrgagagaaagctgaggattgaaagatgatctattggataaaatcttaattatttgagtgtatacggagagcccaatcttcaccattacacaatacacccatgtaacaaacatgcacatgtactccctgaaactaaaaaaaaaagaaacaagcattgtgaactgctggatccccaagaaaggcagatgaccataactaggaa

SEQ ID NO: 539 - DNA, 401 bp, Homo sapiens
aagcaagacaatttgttaaggcttagcatgcaatcaggcatccaaaattccatgaaaaccagaaggcagggtgaggaaggaacaggaaccaggcagcagttctgtgcagtggcaccaagtgacagcaagaaggcagcagtactaccaaggcaagattacacccagccaaaaaaccaccagtctgcagggcagccaattgayactccaggcagagccattcagagctgaagagaaagcactaaaaaaaagtgcagccacttctgtgattaaagacaatgcccatggtactaaagtaccgtcttggagacactggtcatagttgttaaagcttccagccctcccagagaacatctctatgaaaaaaatactggtacagcagccccaggcccaccttctggagg

SEQ ID NO: 540 - DNA, 401 bp, Homo sapiens
ccagaagccccaaaagagcagagaccctgactgatttgttccatggatacctccagcatctagaacaggacatgacatatagtaccccttcaaccagtagttgcctgacttttctgccctcatttaatggatcctgtctctgaacctgcaggcatcatcatatactatcgtaagtgatttccttagcttcctaaacccagraagaatccacattctatttctcatggtttttttctatctgtatagcagcatcaaagtgggccctggtttttagtttgagggatatgccacttctgcaaccagctggcataaatgtggcaattgacacgataagagaagctgttctcccagccagggaagaggcattaccaattacaggcctatactataactgtgccttt

SEQ ID NO: 541 - DNA, 401 bp, Homo sapiens
tcgcacgcatacacacatgctcagacaatgagggtggctatctggcagcttccacctttcccactagagttttcaaatatttgccacactatgccagtgccaaaatttatataataatctatccttcagaggcttctccccttgagctgctcacaatttacccctccttctaactcacaaggagttacaaggccctggaawtgtgcctccctcgacagccacaagtgaaatagtcaccaggttcatggtcttactcgaatccctgtcatgcagggatttcttcatttgcttggaatgactcatcaaacagcctagctttacagttccttgacctcggctcttcccaggacttttatctccatatgtcgacaggaatctactttcttggcacttgttactaa

SEQ ID NO: 542 - DNA, 401 bp, Homo sapiens
ttaaattttctgtagagatagtatttacctatgttgcccaagctgatctcagactcctggcctcaagtgatcctcctcccacctggtatgaagcactgtgcctggccttgaatttcttaatgatgtttttgtgaatctatttgtcaagagtacaactgccagatttttgtgcatttgtgcccctctgctccgaagtacccygactgtcagtctattcattcagtcatcaaataactttggggcatctattctatgccaggcactactatggtaggccttcaataaagggaggctatgtttacatgggccttccacttcacaggcaagaaccgcactactgaatctcccgtgtctttgtccctccagataatttagtgtgcaccttatgaccttcactgaca

SEQ ID NO: 543 - DNA, 401 bp, Homo sapiens
tactaaatcagaaataccaaattcataagtcatttggaagggtaacaaatgtttgatggtttgtcaactagtcttgacaaacggattctacaatgtacagaaattatggagacagttttcactgatagatgttcagtgcctcaaaggaaactcattaagatgagggaatgccctctcaaatgtaacaggattgttgaatayatcaacacaaaagatcactagcaaatggattcctaatgaattcctggttgaatttgcctctgataattatgtattcatattcagtttgagcattcagatgtgttaaatatggccaataatagcactgatttatttcctcctttaatttagaatatctttaagtagttagaaggaaacccttgttaactaatccattgaca

SEQ ID NO: 544 - DNA, 401 bp, Homo sapiens
acttttctttccaaagggaaaaatttttacttatgaaaaatgtggtaaaatatagaataggaaattctgaaagatacaagttcttcttgaacaatgagcaatgtaaaaatgataaaattattgcatgatacaatcttttttaaaaaagagaaaacactgagcatcttttccttaagccccctttcataaaatctcatattwtgcccacttctccatcttaatgattgtggatttctttctcaagacctacttaatacatctcagttggaatttcgaaatgctggcaagtctttaaaaatagacagatgatgaccctaagacatttggaacttatcctaaaggctgaggcacagtagagaaaatatattgaataatatacaattttggtcaggaaatgagga

SEQ ID NO: 545 - DNA, 401 bp, Homo sapiens
aaaagaagtatttcttaccttcttctctaagactgcacattccttgggggtttacccatttgagactgcaagaagatgaaataactcacttttctctattaaaaggtgatctcaattgctatagagagaagaaataaacaattattaatattcctgtgtcagagagtgtttataaaagcaaactgtgaggttcgtaatctktttttagacaagaaaaagatttaaagaatgacttaaagtgatgattataagaaaataaggagaaaaaggagagagaggagaggttaataggtaggggaaattgattctagaccaagcacttaagaattctagttctatgtttgatttcctttttatacatcttgcactttgctctaaagcaaaggagttacaaaattttt

SEQ ID NO: 546 - DNA, 401 bp, Homo sapiens
agttctgcttcccaagttcatgtaccattccagcaaattccggaattcttttcatactattcattctacaataacttgacccctctttttgttgacgatgactttctgttgcttacaataaaaagaccccagtagctgggcacagtggctcatgcctgtaatcccagcactttaggaggctgaggtgggcaggtcgcctgrtgtcgggagtttcagaccagcctatccaacatggtaaaaccctgtctctactaaaaatacaaaaattagctggacatggtggtgtgcgcctgtagtcccagactcaggaggctgaggcaggagaatcagttgaacccaggaggcagaggttgcagtgaagccgagattactgttgattactgttacactccaacctgggt

SEQ ID NO: 547 - DNA, 401 bp, Homo sapiens
ctaaaaatacaaaaattagctggacatggtggtgtgcgcctgtagtcccagactcaggaggctgaggcaggagaatcagttgaacccaggaggcagaggttgcagtgaagccgagattactgttgattactgttacactccaacctgggtgagagagagactctgtctcaaaaaaaaaaaaaaaaaaaaaaaaaaaaagamcaaaacaaaaaaaagcctaaattatacaacaggatccatgggagaacatcttgatagctttttagcaggaacatcacattccaaatgcttgctagctattttctgagtatcagttatatttaccatgatcctgaggagcagaccctttattgtgtcccagttcagtttgcatcgtcttcatacagcataaggcaacagtg

SEQ ID NO: 548 - DNA, 401 bp, Homo sapiens
agagtggtttgtggttggaatttctcttgcttgttgatatatgtactttccatgttggactttgtgcttatgtgaattctccacgtctcaaaggcattatgtctagcaagcaatttctcataaattcttatccatacagttattctatgagagcattgcaaatatagtcagattaggctttgatttgtttttcattctaaygctatctaacaaggggatgttctgatttgtgtagccctgtgcctccaagaagttaacggtaccagatacacagctcatttattttcattgtgcccatgtggttttctgaagtcacactttgtgttgttttacatatgggaaaatggaaacctggctaacttgtctttagtaagtgattggtggagaaattagtagaaact

SEQ ID NO: 549 - DNA, 401 bp, Homo sapiens
agctaaaattgaatgagttagttacaaagtctgtggggttgactcgagtagagggtggttgatcagtgtaggtttaatgaaattaaaatgagtaagattctataaatgcaagactggccagagaaagtggggagctctggggccagaacagcagaggaccaaaggcatcctacacagccaattaaggaattttcctactgmagcatggggtccagggagcttcatttgtaatcccttgttctgctttgtttcattcttggactctaatatggtttgactgtgtcctcacttgaatctcaccttgagttataacaatccccacgtgtcaaggttggtgccaggtggagatgattgaatcatgggggcagtttcccccatactgttctcctggtaagtaaata

SEQ ID NO: 550 - DNA, 401 bp, Homo sapiens
aatattactaccattattgcaattgcgtagtagtacatgccaaattcaccctgtcttttcattttacttacctttctcttgtcccacatgcttttattcttggcatgcttacctacaaaattatcctttttttctatttccgtattccctatgccctgtagtcttctttcaaagcccctttgaaatgctatcatgaaagayggatttcttttctcagtgctgtgagcacctccatctcctcttctcttctttcacggtgcccatttcttcttcatctcatcaagtatgcagtcctttcttcgtctgcactgttatgtacctccttccacctttgtttcttccaaacttgtatttcttttgtctttccatttaacaggcctcatttcttttatcttaggaat

SEQ ID NO: 551 - DNA, 401 bp, Homo sapiens
cactccaattaaacaaaagtctatgtccagttgaagtctggaagcctgataagcacactgaagtaaaagtcgcaatacacatgaatgactgaaagtaggttttgttaccagtggaaaagacatttgtgagaacaaaatgacacataaagaggaagcaagtgattactgacttactggaaatcccaggccgggcacggaggytcattcctgtaatcccaacactttgggaggctgagatgaggggcttacctgagctcaggagtctaagaccagcctgagtaacaagtgagaccctcttctctaccaaaaaataatttaaaaaaaattagccaggtatggtagcccatgcccatgcctgtggcctcagctactcaggaggctgaagcaagaaaattgcttga

SEQ ID NO: 552 - DNA, 401 bp, Homo sapiens
accccatgccccatctctactaagggggggtgggattcactgtcaaaagagttcttctctttaaattctatacaataggtacagtaattatatctaattgcatttgaaacacaatagttattaaggcaaacgtttctagactagtttcattattaaataaaaattgaaactgagagtttttcccatattggtaaatattgwtttaattttttaattgaatgggaataatatgggcatttttttatcatttgcccaaaatattttaagaaaatactatatagtgtaaccttttttttttttttttactatgaaggcattaattttgttttatttttagtacttgcttccagttcacttttcaaagtgtcctttaggcttgttagtttcaaaggaaataatat

SEQ ID NO: 553 - DNA, 401 bp, Homo sapiens
tagaatttaaataacttgctcaggaaggcatagccaataaatggaataagtaagtctcaaatctggacagtctatcttgagaaatgcatgcttaatcaccatcctctattgcctcttaaataatcaaagcccgtaaagattttataaatgacttttctcatgaataatagggcctggggtgagtttctcaatatcacttayggcaataagaatttcagcaatcataatcttggtgcattttccaaaaaggatggctccccattgggtaacacaaggtgaaatgtgtattctgttagaaatttttgattccagcctagggaggtatcaagaataatgctgttgccataaagatataagtcttgagacaaacactggagaggttcagtcattcaatcaactat

SEQ ID NO: 554 - DNA, 401 bp, Homo sapiens
ttttgcttcccctttcagaggaaactacatttgatcattaaaccaatacatcatttatattcattttttcaaaatatattaggttggtgcaacagtgattgaagttttgtcattgaaagtaatggcaaaaaccacacttttgcacctacctaatataaaacttcatttttgttttgtctttcatattgatgaaccatcatytgtttatttttttggatattggattgccttcattgttttcactattataaatacccctattacacatacaaaatcaaaataccatttttgccttggctttttaagaaaataaacgttgattttaaaaacaatttcagatatacagaaaaattgtgaagatactacagtgaattctcatttccctctaccatgttccccct

SEQ ID NO: 555 - DNA, 401 bp, Homo sapiens
ataattattaaattctattgtatgcttgtagctgaacaaaatttttaacccatattgctgtaggaaagacactttatcaactagagagtttgagtttatgtgcagttcctcttccttttagacttacagactccactcatttccaaaattactgttaaccacttttaccttcagtgaggttgtagtgtacatttgtgatayagttatattcttttggaacagcctgcattccatcctgtgataaatatgtattgcaaactctaaagaaacctttttaaaatgactaaaaagaagattaaagatgcagtgatgcgggaaatcagtaaggatataaaatcagtaatttgacctgaacagcactatcaatcaatttgttctaattgacatgtatagactattcc

SEQ ID NO: 556 - DNA, 401 bp, Homo sapiens
ttctcaccacgatgtcagtacggaagtttgaaagaaaaatgtatgcgtctcccgtagagcccatgaacttgttttcttttgcatattatagaatctgcaggtatttttcaaatgaggaccacaaacattcaagtattaggttttcttacaatgacagccaatttagcaagcccaaggttttagagcatccttcaagaggcwggttccatttgcacgttcatgttcaattcgcaaagcaacagcagcagcctttacgtatcccacgattaacacttcaacctccagcccattttgtaaggttaggcattcatcaaaatgtcagaatgattacagtacagatctaaaatcccttttgtcagacactggactttaatccgctcttttctgtagtcacgtcctgt

SEQ ID NO: 557 - DNA, 401 bp, Homo sapiens
taaatttctgttgtttaggccacccagtctgtagtgcttgtaatgtcagccccagcaaacaaatacagcctctcaactatgtctcatcggtaaattaattatttctccccaactcataccataaaatattttagacagcttgcacaagcccccaaacaaaaaaactgtgatgaaatggctaaatagtgtagtagccatggygtatacgaatataaacagaaacatcgtaacaggaaaaaataagaaagtccattagatgcagttgagcttccagcttgtctcttagtttcctggaaaccaaagtgaaaggaggtacctgtttggtcagaaaagttttagtattacaaaggaaatagcattgtatttctttaggggaagcaaaaactttttcttagccctaa

SEQ ID NO: 558 - DNA, 401 bp, Homo sapiens
tcttataaacataagaaagctacataagcatcacaaaaaattacaaacagctatgcctcattttcataagtgatgtcctgactctatctgatctagttttcatgtaagtcctttgccactttacatctatcctcaaaagcctaacggaatctggctggataccccaggtgcttcctcaacgtagaagttttctcttgtttktttttttttttattctgagttattttgaatatatcagtcaattttaatctaaacttgcattatgttttcaaatacaatataagaatttaattaaaaacaatgcttcactgacagcagctctacaattctgtatttgacattgtagtacaacatgcaaaggcatgtattgaggtcagtctgaaatgaaacacttagcctct

SEQ ID NO: 559 - DNA, 401 bp, Homo sapiens
ctcctgatgagctctgagccttctcagtgctatgagtatttacatcaggcagaggtgggttgggatccaaagcttacccaccctaatatgagtaagatgattctattacattcatcctagagagaatatccttcatagaaatagaggaagaaaaagcttgcatttggttaggaatatagattatgaagagcctccttatcytgaaagctgagataatatctgtatcatatgtggtaacaaaaaataaggttatttgtataaagaagttagcatataggaaggtatatagtaaagtgcttcataatggcaggaaggaaagaaatattgaaggaaaaatttaaaagacattgcgtcagttggtatctgtttttggcaagtaaacaaacaaaatatattttctc

SEQ ID NO: 560 - DNA, 401 bp, Homo sapiens
atatgccacataaccataattcatcctggcaattaggtaaacagtatacagaatatgactctcgccattaaataaacttaagcaaggtatctttatcctgaaggaattcttagagatttcatcatgagtaagcacttttcagtatagaattgccaaaatacaaaagaacaccagagaaccactctaacttctaaaaaaaawaagaaacccaaaaccttgtgattgaaaaaaaaaaaaaaagtaagaaaaagaggcccttagtcattctgttcccttttgggcctctatctttcatttcctctggggaaataaagttataaactgtgctggcagtaatctagggtgatgccaagtcagttacccacccccaactccatgtctccaaaagattctttaccacc

SEQ ID NO: 561 - DNA, 401 bp, Homo sapiens
aagaaaaagaggcccttagtcattctgttcccttttgggcctctatctttcatttcctctggggaaataaagttataaactgtgctggcagtaatctagggtgatgccaagtcagttacccacccccaactccatgtctccaaaagattctttaccaccctttgactctaattaaagaaaacaaatgtttccagttttctrtcatgtacctttccactctgaattatagaatagctttcttgaaattcttttaattgttttttacaaaggattagcattaaattcatagataaaaataaattagtaatagtgatcaaaatgacctaactccactttgtttttacttttcttctgggtaggagggcaaataacataactgcttatatggtgatttattttaa

SEQ ID NO: 562 - DNA, 401 bp, Homo sapiens
gataaaaataaattagtaatagtgatcaaaatgacctaactccactttgtttttacttttcttctgggtaggagggcaaataacataactgcttatatggtgatttattttaaattgaatctgaatttctatttcttaaggcctcattggcttcatggcaaataagagagttttaaagaatttattgtgttaatttctgaraaaccaggagtttactgttgacaataatggcacaaattacaactcctacacagctctaccccctccacttttgagtttcaagacttttgccaaagttttctggtctttgttcacttctattattaacatctcttgtgtgaaggggaattttgaatgaatgggatgaaatcatctaaaccagcttcggtcctaaatatagt

SEQ ID NO: 563 - DNA, 401 bp, Homo sapiens
tttgccaaagttttctggtctttgttcacttctattattaacatctcttgtgtgaaggggaattttgaatgaatgggatgaaatcatctaaaccagcttcggtcctaaatatagtgtctggcatcaggtctgggaaaaaaaaaattggtcaaagagatagcctgaggttatttttaggaagttggatgtttagggaaattratactatgaaagttctggcctctatctctgaagatattccattgagagatacatgcatgcattcaacatctcgtttttttccattcctgcccttygggtgttccgcgtcattcactatcttgtcattacagcattaagcagaagcttgaggcagaagatagctaatgcaacgtttccatttggtcctgtaatttttctgc

SEQ ID NO: 564 - DNA, 401 bp, Homo sapiens
gcttcggtcctaaatatagtgtctggcatcaggtctgggaaaaaaaaaattggtcaaagagatagcctgaggttatttttaggaagttggatgtttagggaaattratactatgaaagttctggcctctatctctgaagatattccattgagagatacatgcatgcattcaacatctcgtttttttccattcctgcccttygggtgttccgcgtcattcactatcttgtcattacagcattaagcagaagcttgaggcagaagatagctaatgcaacgtttccatttggtcctgtaatttttctgcacagagctttataggatttcatttcgggttaataaggggaagttggaaccgaggagaaagcttatgctctgccaacatatactgaggattactaa

SEQ ID NO: 565 - DNA, 401 bp, Homo sapiens
ataaatgtcacatgttcgttgaatgatccagatgtttcaaatatacagttgttttatatttggtaaacaatgcagttaggtcatgtaaattttaatttttcatttggagtttatccctatgcaggcaatcatagattagaaagttatttttttcatgtcctacctctttgaattgtcaggttcttttaaatgctgttatgyagcaataaataatattttatccataatcaaggtggatgacttactggatatcagatattattattaacaaaaagtttactacattgtacaartatcactagacaaagacaacctctagaaagttaattaaggtaactaaggttctcaactgcaaccacaaaactttcacagttaataataatttcacagttattaacata

SEQ ID NO: 566 - DNA, 401 bp, Homo sapiens
taatttttcatttggagtttatccctatgcaggcaatcatagattagaaagttatttttttcatgtcctacctctttgaattgtcaggttcttttaaatgctgttatgyagcaataaataatattttatccataatcaaggtggatgacttactggatatcagatattattattaacaaaaagtttactacattgtacaartatcactagacaaagacaacctctagaaagttaattaaggtaactaaggttctcaactgcaaccacaaaactttcacagttaataataatttcacagttattaacataactttttsaagaggtactatactaaaccaaggatgctaaatataacttattaatttctgtgatggcttctggggatatcaatattggtatac

SEQ ID NO: 567 - DNA, 401 bp, Homo sapiens
aataatattttatccataatcaaggtggatgacttactggatatcagatattattattaacaaaaagtttactacattgtacaartatcactagacaaagacaacctctagaaagttaattaaggtaactaaggttctcaactgcaaccacaaaactttcacagttaataataatttcacagttattaacataactttttsaagaggtactatactaaaccaaggatgctaaatataacttattaatttctgtgatggcttctggggatatcaatattggtatactttcctcactgcaatgaagacacttctgcatctacttttgagatttttttggtcatctttctagcagccagctgtcacctcttgctgctgtaacagttcctagtaatagttccctt

SEQ ID NO: 568 - DNA, 401 bp, Homo sapiens
gtaaatatatgtttgaaaaagaattaatgagctcttaattgcagatcaaaggatatggtttgatagtgaagtggcccaatgaaagttgtttgaattttccttttgtctttctgtaaatggaactgtgttcttgaaagcctctacgtctttatcttgttcctcaagattcttagggcagtgcgtgtgggtcaggggtaggtrtgtctgggaattaagagtatctagttgatttagtagctatatttctcttctttagcctgtttattgggaaatgaaagacaatttaggctatttcattttcagtcagtgtctgttatgaattcattggaaayagcaatgtgaaaagaggaatgaatattgtagatttctttcattgtcatatttgtaaattactgggtggg

SEQ ID NO: 569 - DNA, 401 bp, Homo sapiens
tgaaagcctctacgtctttatcttgttcctcaagattcttagggcagtgcgtgtgggtcaggggtaggtrtgtctgggaattaagagtatctagttgatttagtagctatatttctcttctttagcctgtttattgggaaatgaaagacaatttaggctatttcattttcagtcagtgtctgttatgaattcattggaaayagcaatgtgaaaagaggaatgaatattgtagatttctttcattgtcatatttgtaaattactgggtgggatttataaacaaattattgactaattatgaacaaactgttgtttttttcttttcaatcaatatgaacaatcaagtgacctaacamatttaattttaaaaatagatttgaaaggtatatagtagttaaaaca

SEQ ID NO: 570 - DNA, 401 bp, Homo sapiens
aggctatttcattttcagtcagtgtctgttatgaattcattggaaayagcaatgtgaaaagaggaatgaatattgtagatttctttcattgtcatatttgtaaattactgggtgggatttataaacaaattattgactaattatgaacaaactgttgtttttttcttttcaatcaatatgaacaatcaagtgacctaacamatttaattttaaaaatagatttgaaaggtatatagtagttaaaacaaggccccttgattcagattgcctgagttcatatctcaaataggctacttttttgtggtgtgcctttaggcaggatgcctcagtttcctcatatgtaaaaaagaaatgttaatagcagcttaccttgtggggttgttgtgagtgggtcaaatgac

SEQ ID NO: 571 - DNA, 401 bp, Homo sapiens
taaatcatgccagtcaggaaaaggggtacattggttattctatttataacattacttgagtatttataacaacaagtaaacaaaacgttttttagaaaaagaagagattactgtgttgtacaaatattactagatgggtaatttctctcctttttttccaatgtattccagaacccccatggatatcaaaattaaatgctsaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagasggagtctygctctgtcacc

SEQ ID NO: 572 - DNA, 401 bp, Homo sapiens
gatatcaaaattaaatgctsaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagasggagtctygctctgtcacccaggctggagtgcattggtgcaatctcagctcactgcaacctccacctcccaggttcaagcaattctacctgcctcagcccccaagtagctgggattgcaggcacaggccaccacacccacctaatttttgtgttcatagtagagacggggtttcgccgtcttggccaggctggtctcaaa

SEQ ID NO: 573 - DNA, 401 bp, Homo sapiens
aattaaatgctsaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagasggagtctygctctgtcacccaggctggagtgcattggtgcaatctcagctcactgcaacctccacctcccaggttcaagcaattctacctgcctcagcccccaagtagctgggattgcaggcacaggccaccacacccacctaatttttgtgttcatagtagagacggggtttcgccgtcttggccaggctggtctcaaactcttgac

SEQ ID NO: 574 - DNA, 401 bp, Homo sapiens
tatttttccaatatttttgatctatgattggttgaatttgtggaagccaaacccacagacatggagagccagctgtgtattgttattgtcatgtcttttattctcccctgttcttttctgcctaaatgccttaggtacttctttacagagttagatagcatttaccattgataccacccagagtggtgtggtttgcttctyctgaccctttcatgagcaaagctggtttcaggggaaactcagggatctgaacwgttagtaacactgattagaaatgcagcagttttattcaggccttggttttattgaccatttttggttggctcttatctctgtgactgatcatgtatgcgtatttcaaatggataaataaactaaaaagtgtttaatactccaaaatg

SEQ ID NO: 575 - DNA, 401 bp, Homo sapiens
cacagacatggagagccagctgtgtattgttattgtcatgtcttttattctcccctgttcttttctgcctaaatgccttaggtacttctttacagagttagatagcatttaccattgataccacccagagtggtgtggtttgcttctyctgaccctttcatgagcaaagctggtttcaggggaaactcagggatctgaacwgttagtaacactgattagaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcag

SEQ ID NO: 576 - DNA, 401 bp, Homo sapiens
tagaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcagcatgttattctgttarcrtagttcacgttgagtgtttgtattcatttgttgtttgtttgtttgtaagtaacaggttttgactaaaattccacggactgtggaacarcacacactggggtctatcggagggtggaaagtgggtggagggagtgggtcaggaaaaataactaatgtatactaggcttaatacctgggtgataagatagtctttacaac

SEQ ID NO: 577 - DNA, 401 bp, Homo sapiens
gaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcagcatgttattctgttarcrtagttcacgttgagtgtttgtattcatttgttgtttgtttgtttgtaagtaacaggttttgactaaaattccacggactgtggaacarcacacactggggtctatcggagggtggaaagtgggtggagggagtgggtcaggaaaaataactaatgtatactaggcttaatacctgggtgataagatagtctttacaacaa

SEQ ID NO: 578 - DNA, 401 bp, Homo sapiens
aaatggataaataaactaaaaagtgtttaatactccaaaatgattagaagtgtattgttaaataccaaaaagaaaataattctggggtgtttcagcatgttattctgttarcrtagttcacgttgagtgtttgtattcatttgttgtttgtttgtttgtaagtaacaggttttgactaaaattccacggactgtggaacarcacacactggggtctatcggagggtggaaagtgggtggagggagtgggtcaggaaaaataactaatgtatactaggcttaatacctgggtgataagatagtctttacaacaaacccccatgacacaagtttacctatataacaaacctgccattgtacacctgaacttaagtaaaaaaaaaaaaaattaagtcatgtaga

SEQ ID NO: 579 - DNA, 401 bp, Homo sapiens
aactagtaagattaatctacaacccaggcttctgactctatttcaacattcttctcataatgtcattgaggttacacttaataaacaacgttaaacactctctcttttaaaaaaaattgttggctatacatgttggctcacgcctgtaatcccagcactttgggaggctgaggcaggtggatcaccagagttcaggagttygagaccagcctggccaacatggtgaaaccccgtctctactaaaactacaaaaattagctgggcatggttgcaagtgcctataatcccagctacttgggatactgaggcaggagaatcgctggaacccgggaggcagaggttgcagtgagctgaaatcgcacattgcmctccagcctgggcgacaagagcaaaacttcatc

SEQ ID NO: 580 - DNA, 401 bp, Homo sapiens
ctgaggcaggtggatcaccagagttcaggagttygagaccagcctggccaacatggtgaaaccccgtctctactaaaactacaaaaattagctgggcatggttgcaagtgcctataatcccagctacttgggatactgaggcaggagaatcgctggaacccgggaggcagaggttgcagtgagctgaaatcgcacattgcmctccagcctgggcgacaagagcaaaacttcatcccctcccccccaaaaaattgttaactactacaagcataaatatgaatatctacttacctgcatttctgaagctagaccataagtattaacagtgcttatatctacagtccctggcagatagtcggtgtaagaaatatagattaattgaatgaatcatatgatcatgg

SEQ ID NO: 581 - DNA, 401 bp, Homo sapiens
gcctgggcgacaagagcaaaacttcatcccctcccccccaaaaaattgttaactactacaagcataaatatgaatatctacttacctgcatttctgaagctagaccataagtattaacagtgcttatatctacagtccctggcagatagtcggtgtaagaaatatagattaattgaatgaatcatatgatcatggttaagkttcttcttttgtgcgttttagcatttttaaatttttacattgatcatgtattgcttttgaaattttaaaaaacctggcaaaatrtaattacgatagaaactgacatcaaaaagctttgtagctgaaatagtgtaattttacactgagtttgaaacttctgatatcaggaactttgatgagcctaatacaggtgctatacg

SEQ ID NO: 582 - DNA, 401 bp, Homo sapiens
cctgcatttctgaagctagaccataagtattaacagtgcttatatctacagtccctggcagatagtcggtgtaagaaatatagattaattgaatgaatcatatgatcatggttaagkttcttcttttgtgcgttttagcatttttaaatttttacattgatcatgtattgcttttgaaattttaaaaaacctggcaaaatrtaattacgatagaaactgacatcaaaaagctttgtagctgaaatagtgtaattttacactgagtttgaaacttctgatatcaggaactttgatgagcctaatacaggtgctatacgggatgaagtgaatatgcttagaatttttgatgaaaacaaatctgactaytcaggtttctctatgagaagggtaggcagtttgat

SEQ ID NO: 583 - DNA, 401 bp, Homo sapiens
tattgcttttgaaattttaaaaaacctggcaaaatrtaattacgatagaaactgacatcaaaaagctttgtagctgaaatagtgtaattttacactgagtttgaaacttctgatatcaggaactttgatgagcctaatacaggtgctatacgggatgaagtgaatatgcttagaatttttgatgaaaacaaatctgactaytcaggtttctctatgagaagggtaggcagtttgatttgtaattatgggaagctgaatgtgaggcttggatgaggctttgtcagtatcagaccagctccttcctattgggggctgaattcccttgggctctccatcagagagaccaacaggaagcaatcatgtagttcttccaacacactcagaagtcagtaggtccactc

SEQ ID NO: 584 - DNA, 401 bp, Homo sapiens
cataggttccctcccagtggtaatgagtgagttcttactctgttagttcatgcaagaattgatggtttaaaagagtctggtgattctctcccctctctcctgcctgtgctctcaccatgtgacatgtctattcctccttcaccttccagcatgattgcaagcttcctgagttcctgaccagaagcagatgctggcaccacrctttgtgtatagcctttagaaccatgagccaaatcaaccacttttctttatgaattattcagtcccaggtattcctttatagcaacacaaaacaggcaaataccggagcaacagatcagaataaataacgctgagaggacctgacctgatttgctrtaggtattgttctagggtagcccctggtatccattgaagactct

SEQ ID NO: 585 - DNA, 401 bp, Homo sapiens
gcaagcttcctgagttcctgaccagaagcagatgctggcaccacrctttgtgtatagcctttagaaccatgagccaaatcaaccacttttctttatgaattattcagtcccaggtattcctttatagcaacacaaaacaggcaaataccggagcaacagatcagaataaataacgctgagaggacctgacctgatttgctrtaggtattgttctagggtagcccctggtatccattgaagactctgaccgtgagctctgcctgcattaatataactggaccaaaggaaacagaactttagttttatgaatgggtgtctctccaaacaatttttcctggctgagctttgttcattaacatttttcaatttctaaagaacaaataatctccatttctcttttt

SEQ ID NO: 586 - DNA, 401 bp, Homo sapiens
attaatgactcattctctctgttgagtgagggcttattccagctggctcgcgctattctgtgtgtatggattctgtcagcagggttgaaataagatgttaactggcagttattcattaatttacagcaagaacaatgacttgactctatgtcaaccatttctgaaacattttgactaacatttttcctgttgcttagaackgaacttaaaagctgggacaggcatatggaaagaagcaaggatccccagttatgctgattggaactaggactaatggttttaacacagaatgtttatgcatgtagaatgaaatacacacacacacacacacacacacacacacacatacacgcacatacaaggggtcatactttatgtttgcattttcctctaaaagtatc

SEQ ID NO: 587 - DNA, 401 bp, Homo sapiens
ttttttcatcatagtttgtttaaaagataaagcagatattataattattttctttacaggtgggaatgagttaaacaataattaactgaacaaaagcaatgtccaggtactgcaaaactttacataaattactcctattcattttcacagcaaccctctgaagtaaatggtattatcccaacttacagatgtggaaactartactaattaacttacctagaatcgaggtggcagagccaagacacgaattcaagtttctcttcctcaaatttaacattctttcttgtacaaatgtaaatgttctttaaaaatgaatacataatggcaggattcatatcaattttctgccagaattaccatgtttacctgaagtaaaatatgctcataaacaaagcagaaag

SEQ ID NO: 588 - DNA, 401 bp, Homo sapiens
cataaacaaagcagaaagtgcagctggtgcttacatctaggatgattaactggcatgtacagaatttttttttccttcaattgcaaagtgaatgcagtaaaattacagggcaatgggtttcttcccacacaagacaaggtgatctgaatgatatagaagagaaatgccacatgtggaaataatatatcaaggatttattaygtgtctgtggtcattcttaaggtcatttttgatgtctacacatttcagcatttgagaagttgtatattacatgcatacaaacccatattcaaatatacaattggctaaacaagtatttgttttaataaagtagtartaataaaatatttatagcaaaggrgacaagactcaggactgagaggaaaaactcaattaaaaaa

SEQ ID NO: 589 - DNA, 401 bp, Homo sapiens
aggtgatctgaatgatatagaagagaaatgccacatgtggaaataatatatcaaggatttattaygtgtctgtggtcattcttaaggtcatttttgatgtctacacatttcagcatttgagaagttgtatattacatgcatacaaacccatattcaaatatacaattggctaaacaagtatttgttttaataaagtagtartaataaaatatttatagcaaaggrgacaagactcaggactgagaggaaaaactcaattaaaaaaaagacaacaatacttaaatctcttgatgcatctacttagcaatgtctacaatagcttttttaacactatcagaatatagagcataaattataatgtttatcctgcttttaaaggaaaatttttctcttatgcaatc

SEQ ID NO: 590 - DNA, 401 bp, Homo sapiens
gaaatgccacatgtggaaataatatatcaaggatttattaygtgtctgtggtcattcttaaggtcatttttgatgtctacacatttcagcatttgagaagttgtatattacatgcatacaaacccatattcaaatatacaattggctaaacaagtatttgttttaataaagtagtartaataaaatatttatagcaaaggrgacaagactcaggactgagaggaaaaactcaattaaaaaaaagacaacaatacttaaatctcttgatgcatctacttagcaatgtctacaatagcttttttaacactatcagaatatagagcataaattataatgtttatcctgcttttaaaggaaaatttttctcttatgcaatcatggtgggagaaaagaattcttaa

SEQ ID NO: 591 - DNA, 401 bp, Homo sapiens
taacactatcagaatatagagcataaattataatgtttatcctgcttttaaaggaaaatttttctcttatgcaatcatggtgggagaaaagaattcttaacgtgattatttgtctcatattttattttaggattctgttagtgtttttaggattctatcaatgcaaggtgtaagaacatgtcctggcagttgaaggaaagrctaaggaaaaagatgaaagagaagtgtcgcatcccttaccctccttttaaagaaatgctgaagttgctgagcagaargtgccacagtcatgtcccttaatttatccctcaaccttttccagaagtaaagtgactacacctaagctcagacagtgacagtcgtgggagaaaagctttatagraacagtgataggaataaaa

SEQ ID NO: 592 - DNA, 401 bp, Homo sapiens
tggtgggagaaaagaattcttaacgtgattatttgtctcatattttattttaggattctgttagtgtttttaggattctatcaatgcaaggtgtaagaacatgtcctggcagttgaaggaaagrctaaggaaaaagatgaaagagaagtgtcgcatcccttaccctccttttaaagaaatgctgaagttgctgagcagaargtgccacagtcatgtcccttaatttatccctcaaccttttccagaagtaaagtgactacacctaagctcagacagtgacagtcgtgggagaaaagctttatagraacagtgataggaataaaagtgtgtgcactgggatagatgtattttttaattacagaagtaactactaatctatataagagaggctccttccactc

SEQ ID NO: 593 - DNA, 401 bp, Homo sapiens
cctggcagttgaaggaaagrctaaggaaaaagatgaaagagaagtgtcgcatcccttaccctccttttaaagaaatgctgaagttgctgagcagaargtgccacagtcatgtcccttaatttatccctcaaccttttccagaagtaaagtgactacacctaagctcagacagtgacagtcgtgggagaaaagctttatagraacagtgataggaataaaagtgtgtgcactgggatagatgtattttttaattacagaagtaactactaatctatataagagaggctccttccactctcagagcttccaacttaaccatctgtgaagagtaggtccttcaaaaccaactgtagcggcaaagttctgagrtgatatttccagactcagcagataggaacagg

SEQ ID NO: 594 - DNA, 401 bp, Homo sapiens
acagtgacagtcgtgggagaaaagctttatagraacagtgataggaataaaagtgtgtgcactgggatagatgtattttttaattacagaagtaactactaatctatataagagaggctccttccactctcagagcttccaacttaaccatctgtgaagagtaggtccttcaaaaccaactgtagcggcaaagttctgagrtgatatttccagactcagcagataggaacaggcatgctaggtgagatatggcagggaatattagtcagggttctccagagggacagaaccaatttgtgtgtgtgcgtgtgtgtgtgtgtgtgtgtgtgtgtgtgtgtgtgtgtgtgtgtgacagagacagacagaaagagagtgctttagtttaaggaattggctcacaa

SEQ ID NO: 595 - DNA, 401 bp, Homo sapiens
gagaggtcagtcttttgttctattcagatcttcaaccgattgaatcagccccactcaccttatggaggacaatttgcttgactcgaagttcattgatttaaatgtaaatcttgtctgaaaacaccctcctagaaatattcagaataacgtttgacaaaatatccagggaccagggaccatggcccagccaagttgacacaytgaactgaccattacaagtctagttggcacccatatacatctccttaagccattcttaatctccaaatgtggtcacattctgaggaactggtggttasagcttcaacatatgcattttgaggagatacagtgtagtccacatcatggaggtagccctagaatttttttgtttccattcctattggcagagacaattgagg

SEQ ID NO: 596 - DNA, 401 bp, Homo sapiens
taaatgtaaatcttgtctgaaaacaccctcctagaaatattcagaataacgtttgacaaaatatccagggaccagggaccatggcccagccaagttgacacaytgaactgaccattacaagtctagttggcacccatatacatctccttaagccattcttaatctccaaatgtggtcacattctgaggaactggtggttasagcttcaacatatgcattttgaggagatacagtgtagtccacatcatggaggtagccctagaatttttttgtttccattcctattggcagagacaattgaggaaaagggaaagttccctttcatttattttactctcctgcacatctaatctttaaggagagaatagaatgagagttggggcacaaaacaaggattgaag

SEQ ID NO: 597 - DNA, 401 bp, Homo sapiens
tcatggaggtagccctagaatttttttgtttccattcctattggcagagacaattgaggaaaagggaaagttccctttcatttattttactctcctgcacatctaatctttaaggagagaatagaatgagagttggggcacaaaacaaggattgaagggcagctgacttgagtccacgtagccccagaacaaagcaaaggracattagattagtggggtagtagagattaaagaagtaaacagaattgaaactggcagaagatagggtcattgtagagtggaaaaacatatctgaaacatggttgttaagtcataagctaatatttggaaagacagactccacttacttttttccaatagatatatatttactaaaatcttgggaaagctaagcttatgat

SEQ ID NO: 598 - DNA, 401 bp, Homo sapiens
aatttttattttaggttccagggtacatatgcagatttgttatataggtaaactaatgtcataggggtttgtaatacaggttacttcatcacccagggattaagcctgttacccaataggtattttttctgatcctctccctcctcctaccctccaccctccaccctcaagtaggccccagtgtctctttttcacctctaygtgtccatgagttttcatcctttagctcccgcttattagtgagaacatgtagtatttggttttctgttcatgtgtcagtttgctaaggatgttggcctccattcttgccatgaaaaacaacaggaaaataaagcactacccttgagcatgcctctagaacttgaggttcaagaacaacagaagagtggcagaaaactata

SEQ ID NO: 599 - DNA, 401 bp, Homo sapiens
taccaggtgatggttaggaaacagaaaattcctgaagcatctcttctttttaatgaagtatcaaaaatactgttttattaaaatcgggagaaaaaaggctttaggccaagtgtgttgggttggccttgcaactctacttcggttacaaatttaaaggccaaagagttagagattgtgtatatgggtatgtgtgttgcaggktggggtgtgggacatatcaatacaataggtaaaatgaatggtggattgtgtctgggataatgtggcatattttatctcaaatcccaaccttatctcccaataggagatttggatcatgagcaagatttggcttaggctagttttcaattcccaggattccagctccttcatagcaccacccttatgcttactaatccctt

SEQ ID NO: 600 - DNA, 401 bp, Homo sapiens
gatgactgacaaaatttttgaaagtaatagagagaaactgaggcataaaatttacctgaaagcagtcctgtttaaattggacaaaataattaccttttcttacatccctcttttagagttttcctaatatcatttaatacatagatagtactagaaagaaaaagacattttaaattaagaccaatgtgaagcattataccmatttagtatcattttgcccattacccttatagaaactaaaaatagaatgagtgctcagagtttgtactgtaactgcctgccacttacatgggataactatttttagttccatcgtccttattaaaggctttcattatgagttcatttatggaaatgttatctcacagagttttttttggagacttttctgagatctcaaa

SEQ ID NO: 601 - DNA, 401 bp, Homo sapiens
gaaacatgattagaacatagtcatttagtttcccagcaaatgctgatcctttccaggaaagttctataaataaggaaccaaagctggttgtcagtaatttgaagtagctgggttggaccgtgaatattaatatgtaaattatagcttgtgccatctatacacaaccaggattgtatgcatatcttcccatggtttattttmagtctgaatttgcatacaaacactggtctaattgagtttttaaaaaaaattcttaagagatgccatgtgttacttaaagatgttttgttttgaaactttgtgataggtaagatccactaatgtttgtaaaatttaccatttgtaggaaatattctattctcagtaattcctggtgaaagtggtaggtgggttagagatca

SEQ ID NO: 602 - DNA, 401 bp, Homo sapiens
cttaatgctgagtatattgggactcttgtaaatggacattttgttcatggatattttgttttagcaatttaaagaatgttaactagcttaatattttagagtgaacattttaaagtgataaagaaaaataagaaactttcttatctcaattaaaaatatatatgtatttttggtccacacaaatcacatcacccaaataaktcagagcactttgctagaaaaggcaagacaaggtgtttctgagagtgtctccgcatttagatagactatttagttccatacttagagatcatccactagggtttctttgagcttggtgaagaatattcagcaacttgcctaagctctgggaatgtgagcatcagttatgaatataggtcatctcagtttgtgcacagcac

SEQ ID NO: 603 - DNA, 401 bp, Homo sapiens
cagagcactttgctagaaaaggcaagacaaggtgtttctgagagtgtctccgcatttagatagactatttagttccatacttagagatcatccactagggtttctttgagcttggtgaagaatattcagcaacttgcctaagctctgggaatgtgagcatcagttatgaatataggtcatctcagtttgtgcacagcacaytttctgtcagtccaatataaacttgtatgagtagatctgtttattgtgataactacaacttatattaacttgttgacatgctttttctaacttattttcttgggtctgcatttttcaaagatcaaaatttctgcatcttcagcacaagtagattgaagaacacataatacggatagtgattaggaacattcaggcatggg

SEQ ID NO: 604 - DNA, 401 bp, Homo sapiens
aataagctctgcaacttacatttttatatgggaagaaataatgagtcagtcttcttgaagttttttacattattatagtaagaacatttaagatgagatatacccttttaacactttacattttaagtgttcaatatagcattgttaactctagataggacgtttcatagaagatcttagcatctgacgtaactgaaactrcatgcatcgaatagcatctccccatttctcccacttcccagccccaggcaaccaccattcattttactctctgcttctgtgagtttgactattttacatacctcattgataatggtttggatgtttgtcctctccaaatcgcatgtagaaacatgattcccattgttggagatggggtctaatgggaggagattggatcg

SEQ ID NO: 605 - DNA, 401 bp, Homo sapiens
ccagccccaggcaaccaccattcattttactctctgcttctgtgagtttgactattttacatacctcattgataatggtttggatgtttgtcctctccaaatcgcatgtagaaacatgattcccattgttggagatggggtctaatgggaggagattggatcgtgggggcagatccctcatgaatggcttagtaccatctscttggtgataagtaagtttttgctctgagttcatgtgagatctggttgtttaaaagtgtgtagcacctccccaaccgatctcttccccttttgccttccaccatgattatgagcttcctgaggccctcactagaaatagatgctggagccgtggtggtacagcatgcaggactgtgaatcaattaaacctcttttatttc

SEQ ID NO: 606 - DNA, 401 bp, Homo sapiens
gctcttgtatattgacaagagcataaatctatcaacagccaggttcatacatagagtccacctcttaaaggttataagatactgggcaagtcatttcatttctttaaacctgtttcctcatctgtgaaatgctgatagaatcataccttacatagatcagatgtaaataaaatagtcgtaagttagcgctcaggaaattayagtattctgtgcaaatcttattaactttgattttgtttcatatattgataaatttacatctagctgaaaatacattgaatcattgtcatggactaaattttaatatgtcttaggaaaagagtccgggttgaagtgcagtggtgcgaygttggccccctgcagcctccgcctcacaggttcaagtgattctcctgcctcag

SEQ ID NO: 607 - DNA, 401 bp, Homo sapiens
ttacatagatcagatgtaaataaaatagtcgtaagttagcgctcaggaaattayagtattctgtgcaaatcttattaactttgattttgtttcatatattgataaatttacatctagctgaaaatacattgaatcattgtcatggactaaattttaatatgtcttaggaaaagagtccgggttgaagtgcagtggtgcgaygttggccccctgcagcctccgcctcacaggttcaagtgattctcctgcctcagcctcccgagaagctgggattataggtgcatgccatcagacccagctaatttttgtatttttagtagagatggggttttatcatgttgaccaggttgttctcgaactcttgacctcaggtgttctgccggcctcagcctcccaaagtg

SEQ ID NO: 608 - DNA, 401 bp, Homo sapiens
tgccggcctcagcctcccaaagtgctgagattacaggcgtgagccactgcaccggtccaggacaagaatatttttgaaactatgagctttatcatcagagacattaaaacttcagaaggaaagagacctttgagttcttctgagccaactccttccttttatcactaccaacaacatgaagtcagagggaaatgacttgcmtacagtaagatgagcaggaagaagtgaaagcagattaggggctgaggtcttcttagtttatgtccagagatctttccacttcacccaccatactctacattagtcactaccacgaccatcatcatcattatgaccaaaattaaatctaaacaacttttcaccaagtaattccattttcatgctaaagatcaggcagttca

SEQ ID NO: 609 - DNA, 401 bp, Homo sapiens
ggggagaagggacaggaagtactgagatctgaaagcaaattgcctaacatttagaggtgagaatgtgaaatgaggccaaccagggctggtgcagagccagaacaagggaggtcagaaagctaaggtgaaattctggaaataaatatgatgagagcttattgtaggggagacttttgggggactatggcctcgatctgatgkgtctgcttgtccccagtgctccttcaaacatgctccttgaagcttcatgcctgccttagacagccagagattgaaaatgaacatatattttgaaaacaaagacactaagaccattcacaaaaattcaagaagtaattttttaaaaaaaatacagtaacatttaaaaaatatatgttatttcacaacatatgtaaaaccat

SEQ ID NO: 610 - DNA, 401 bp, Homo sapiens
agagatcagactgttattgtgtctatgtagaaagaagtagacgtgagagactccattttgttttgtactaagaaaaattcttctgccttgagatgctgttaatctgtaaccctagccccaaccgtgtgctcgcagagacatgtgctgtgttgactcaaagtttaatggatttagggctatgcaggatgtgcatagcccgaraaacacccacaggtgtggaggggcaggccaccccttcaaaggcaagtgtcatgaatgaagaaattaaggatagcaacaagtataaggcctatgtcacttgcctttggacaaaggtccctttatatttcaatcctggaaagtgaaatgaaaaaactagtgctaaaattaggatcaaagatagtacaggaaagtgtatttaa

SEQ ID NO: 611 - DNA, 401 bp, Homo sapiens
acaataaaacaaaatccatgagataattcatttagtggggcaaaaaacgtttgttggtctttgttttgcttggttttgttttatatgtacaagggcataaagttgacttaggatgtggagttgggaaggagagtagtttggataagatctttgaaaggttgcttatgggtatcctttcctggtcatcaagatgtggatgtrcctctcttgaaattcttactcactgcatctttcagcctggatatgatgcaaaaacatgagcggtgacttcacatttaggtttgaaagcagagcttccctcttattggctgatggttcctgaggatgtctgcagcagagtggcaggacaatctagcagaaatattttccacttaaagagatagggggtttgtgtttggatt

SEQ ID NO: 612 - DNA, 401 bp, Homo sapiens
acttccttagagcaaaggaggggcagccccattaccaaataccacttttgcccaggcttttgtgacatgcagtgctcctgcccagcatggcaccttattttgacaaggaccttgttatctttccaccaagttatcacttgaaatgataatatagcttgtatgttgttcccaagctgtcgtatattttcctggttgtttgawtttaacaatgagaataataaggtttaatactcctccctaagaaaagatttgcttatttcccaatttgaaattactttgctaagagggatataatgagttctatagtgaaacaagtatgtgttttatcctaatttctgaaattattcctgaaaattcaagtccattgtttgtctcccaccctatcctttggttctgtcacc

SEQ ID NO: 613 - DNA, 401 bp, Homo sapiens
agcctcccaagtagctgggattacaggcacacgccatcatgcccagctaatttttgtatttttagtagagacagggtttcaccatgttggccaggatggtcttaatctcctgacctcgtgatccacctgcctccgcctcccaaagtgctgggattacaggcgtgagcctctgcgccgtgccattttcagcattttttgatrtcagttatgggttcattgttttcaatataagataacatgagcagagactgtgtaggtgggattgagagtgaagactgggctcattgacaacctctcatcatctcgtcaagcagagtttcccatatcctctgaatctatgcctgtgtaactccaaatattagcataaatataaaaaattcatccatttggatattttatct

SEQ ID NO: 614 - DNA, 401 bp, Homo sapiens
atggctatgcaaatttccattcaacagcgtataaaagttccattttctcggcatctttgtcagcatttgtaaaattttttttgtctttttgataataaccatactaactagggtaagataatacctcattgtggttttgatttgcatttcccaaataattccaggaaagagatgacattgggttagattagaggggaaccrggggatgagtacaaaagatgaggagaagttagaatctattttagaaacagagtcaacagaactcaccaaatagatgcagttaaggaagcaaggaaagtaactaagggtaacacctgtttgtggcttaagtaactgaataaatgggggtaagacaatatgagacagcaaatatttggggaatattttatgtggtatttttg

SEQ ID NO: 615 - DNA, 401 bp, Homo sapiens
agtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacatkktggatggaaagatgagacactgaaacaatttgaagattggaaggtgagagtctgaggtccaaagctttacaccagttgttgaagaaccttgatcacaggccagccaggacctcaaaggctcaagagaaatgatgacaaggtttgcttggcttatttagagctgggctatagagcgggaagattgtggttaaatcttagc

SEQ ID NO: 616 - DNA, 401 bp, Homo sapiens
gtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacatkktggatggaaagatgagacactgaaacaatttgaagattggaaggtgagagtctgaggtccaaagctttacaccagttgttgaagaaccttgatcacaggccagccaggacctcaaaggctcaagagaaatgatgacaaggtttgcttggcttatttagagctgggctatagagcgggaagattgtggttaaatcttagca

SEQ ID NO: 617 - DNA, 401 bp, Homo sapiens
ctgatgacgctgcatctcagtcataaaaacttcagggaatctgaaagaaataataatgcgccatggtattttgagcttatcaccacaagaaatactctgtaattgcatcaaatgattataaatggcatattttagggacataataagcaatgcaaaggacaggtctgcttattagtgccaaaatttgtatttattcccatrttgctttttttttcctaggcattttccggcatctcatttctgactattaaattataccccaaatagaatatgtaactacatgtaaccaacctattttggtctacattaagtgcagcagcataaatagaaactgaaaataatcagaagcatttagaatttcgtttttattcatctgatttacttggccttttgtctgggat

SEQ ID NO: 618 - DNA, 401 bp, Homo sapiens
attgtatctacaaatagtttagctgaagtgagcttttcagttattgattttaaatcataagtttaattcgtcatcaaggcaacaacaaatgtgatgtttggggcagatgcaaagttgaagtatgtctaaagaaatagcacgctagttgcgtttaatgtggaaggtaaattataacaaaacaaactaaaaccccacaaactstaaagattttcccttatagttatagaaattaggaaatgccctawtgtgcatctttccttcccaactgtacygagattttgaattttttataatttgtactaatatgtaactagaccagatataatctgttgaggctttcttgtgatggaaagcaggtgaaatcaattttcagttgaaatatgcttttcagttcactatat

SEQ ID NO: 619 - DNA, 401 bp, Homo sapiens
tgattttaaatcataagtttaattcgtcatcaaggcaacaacaaatgtgatgtttggggcagatgcaaagttgaagtatgtctaaagaaatagcacgctagttgcgtttaatgtggaaggtaaattataacaaaacaaactaaaaccccacaaactstaaagattttcccttatagttatagaaattaggaaatgccctawtgtgcatctttccttcccaactgtacygagattttgaattttttataatttgtactaatatgtaactagaccagatataatctgttgaggctttcttgtgatggaaagcaggtgaaatcaattttcagttgaaatatgcttttcagttcactatatgatgtttgtagggcttttttagagaagggctttgcatttagact

SEQ ID NO: 620 - DNA, 401 bp, Homo sapiens
catcaaggcaacaacaaatgtgatgtttggggcagatgcaaagttgaagtatgtctaaagaaatagcacgctagttgcgtttaatgtggaaggtaaattataacaaaacaaactaaaaccccacaaactstaaagattttcccttatagttatagaaattaggaaatgccctawtgtgcatctttccttcccaactgtacygagattttgaattttttataatttgtactaatatgtaactagaccagatataatctgttgaggctttcttgtgatggaaagcaggtgaaatcaattttcagttgaaatatgcttttcagttcactatatgatgtttgtagggcttttttagagaagggctttgcatttagacttgagcagtttagcaggcttcgtcggag

SEQ ID NO: 621 - DNA, 401 bp, Homo sapiens
actagaccagatataatctgttgaggctttcttgtgatggaaagcaggtgaaatcaattttcagttgaaatatgcttttcagttcactatatgatgtttgtagggcttttttagagaagggctttgcatttagacttgagcagtttagcaggcttcgtcggagggtaaatctggctgctggatctagttggaatgttttcytttcataagaagagttggagataaagtgattcttgctttcaaatacacttttaacaatacaaaagaataattgaagactttttcttttgagacagagtctcactctgttgcccaggatggaatgcagcggaacaatttcgactcattgtagcctcracctctcaggctcaggtgatcctcctacctcagcctcccaagta

SEQ ID NO: 622 - DNA, 401 bp, Homo sapiens
gtcggagggtaaatctggctgctggatctagttggaatgttttcytttcataagaagagttggagataaagtgattcttgctttcaaatacacttttaacaatacaaaagaataattgaagactttttcttttgagacagagtctcactctgttgcccaggatggaatgcagcggaacaatttcgactcattgtagcctcracctctcaggctcaggtgatcctcctacctcagcctcccaagtagctgggactacaggcgtgtgccaccacatctggctaatttttgtatgttttgtagagttggggttttgctatgttgcccaggctggtcttgaactcctgggctcaagctttcctccctccttggcatcccagagtgctgggattacaggtgtaagc

SEQ ID NO: 623 - DNA, 401 bp, Homo sapiens
tctcaggctcaggtgatcctcctacctcagcctcccaagtagctgggactacaggcgtgtgccaccacatctggctaatttttgtatgttttgtagagttggggttttgctatgttgcccaggctggtcttgaactcctgggctcaagctttcctccctccttggcatcccagagtgctgggattacaggtgtaagccacygatcccagcctaattgaagacttttgtatgttaggtgctaagtaatacaaaagtaaaagtgccactgtttctgtcctcaaggaatttacagtctggagaaggagacaaaatataaacaaacacactgataagtaaatgattacaaattgtgccaagtgccatgatagaaaagaattgatgtgcattatctctgtgctccc

SEQ ID NO: 624 - DNA, 401 bp, Homo sapiens
ttgatcatacccatcagtcttccaggtataccaaggacattggattgaatgtcacaggacctggattcaagccctgccatcgaatccagctgggtgtttctgggcttcagtttctgtatattcagtaatagtatcgaatattagtgggagtaatagcattgaatgccctccatgctcactggaacttcatccacaattacmatgtcttggtggctttctaagtttttttttaatttttaatttctaatttttgtaggtacacagtaggtgtctatatttatggggtatgtgagatattttgataaaggcatgcaatgcataataatcacatcatggaaaatggggtatccatctcctcaagcatttatcctttgtgttacaaacaattcaattatgttttt

SEQ ID NO: 625 - DNA, 401 bp, Homo sapiens
acaaacaattcaattatgttttttaagttattttaaaatgtacaaatacattattttggctatagtcacactgtcatgctattaaatgctaggtcttctaattattttttgtaccctttaaccatctctacctctccctgatcccccagtacccttcctatcctctggtaaccatccttccattctctatctccatgggtycagttgttttgatttttacattcagtaaatgagtaagaatacacaatgtttgtctttctgttcctggcttatttcacttaacatgatgaccacagttccatccatattgttgcaaataacaggatctcattgttttcatgaataaatagtactccattgtttatatgtaccacaatttctttgtccattcatgtgttgat

SEQ ID NO: 626 - DNA, 401 bp, Homo sapiens
ataaacactatatttaggctacctatatttatagaaaaatcttctttcttcaataataaattaatgttagcttactgtaactttctgacttaataaatgttttaatttttcaaaactttttgactctttttcaataatagcttgaaatacaaacacattgtacagctgtataaaaataatttctttttatcctcattctayaaacttttttgaatttttaaattttttaatataatttttaaaattttgttaaaaacaaagacacaaacacacacattagcctaggcccacacagggtcaggattgtcagtatcactgtcttccacctccacatcttgtcctactggaaggtcttcagggtaaataacaagcacgaagctgtcatctcctataacaatgcc

SEQ ID NO: 627 - DNA, 401 bp, Homo sapiens
ttgggtgaattcaaacatggccactttgtatgacaaattacatgcttctatttctgttccacccagggtttcttttgagcagtggaaattcatctggaaacttaatgttatcccactatagagagccattcttgatgtgccactaattctgccaaataggctgacttgactactctcttaggatacagaattatatgaagmaaaatagagttgagaaggaaaaagtacaaacgttgtgtgtgcatataacaaacagatgactgctttagacatatttggtctgtaaacacctgtggaatcttgcctgtgtctctaatttttccagattttgctcatgggagagacacaatttgttctttgaatgtagccattatattttaacatacatgctgatttaatca

SEQ ID NO: 628 - DNA, 401 bp, Homo sapiens
cacataggcacatcatctcaggaaggctcaggtagcatagaggcaagtgaattcagcctgagattacagtaaagacatgaatctgatagtctggcatttctggactcacactgatttcttgaagaaaagcccatacagttggaatcagtgccttaaattaggtttcttaatatgatgagctcataaaatatgtgttgtccygccttcttcagatgtgagagttgatgttacagagatctctttggtaatatgactattttaataaaatattcacaattaaaaatrtatagaagaaagcagcaaggaaagactagaactaatgattagagttgttgaaaatgcatacataatttactccctttttaaaaaaaatggaactgggctattctgttgtacataga

SEQ ID NO: 629 - DNA, 401 bp, Homo sapiens
gatagtctggcatttctggactcacactgatttcttgaagaaaagcccatacagttggaatcagtgccttaaattaggtttcttaatatgatgagctcataaaatatgtgttgtccygccttcttcagatgtgagagttgatgttacagagatctctttggtaatatgactattttaataaaatattcacaattaaaaatrtatagaagaaagcagcaaggaaagactagaactaatgattagagttgttgaaaatgcatacataatttactccctttttaaaaaaaatggaactgggctattctgttgtacatagacttttgtcaaaatcaaattaagaatactttactcagttttctttttcttcctttattcatctctgtaaatatgattttaaaggc

SEQ ID NO: 630 - DNA, 401 bp, Homo sapiens
tttttaaaaaaaatggaactgggctattctgttgtacatagacttttgtcaaaatcaaattaagaatactttactcagttttctttttcttcctttattcatctctgtaaatatgattttaaaggcccttgaaaacaaaataattatcttattaaaatttagttacatgttgtgtttaaaatgctaaagttttggccagcygcagtggctcacgcctgtaatcccagtactttgcccgagatgggcagatcatgaggtcaggagttcaagaccagcctgaccaacatggtgaaaccctgtytytactaaaaatmcmacaacaacaacaacaacaacaacaaattagccaggagtggtggtgcgtgcctgtaatcccagctactcaggaggctgaggcagga

SEQ ID NO: 631 - DNA, 401 bp, Homo sapiens
atctctgtaaatatgattttaaaggcccttgaaaacaaaataattatcttattaaaatttagttacatgttgtgtttaaaatgctaaagttttggccagcygcagtggctcacgcctgtaatcccagtactttgcccgagatgggcagatcatgaggtcaggagttcaagaccagcctgaccaacatggtgaaaccctgtytytactaaaaatmcmacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctraaatttatc

SEQ ID NO: 632 - DNA, 401 bp, Homo sapiens
ctctgtaaatatgattttaaaggcccttgaaaacaaaataattatcttattaaaatttagttacatgttgtgtttaaaatgctaaagttttggccagcygcagtggctcacgcctgtaatcccagtactttgcccgagatgggcagatcatgaggtcaggagttcaagaccagcctgaccaacatggtgaaaccctgtytytactaaaaatmcmacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctraaatttatcgg

SEQ ID NO: 633 - DNA, 401 bp, Homo sapiens
tgattttaaaggcccttgaaaacaaaataattatcttattaaaatttagttacatgttgtgtttaaaatgctaaagttttggccagcygcagtggctcacgcctgtaatcccagtactttgcccgagatgggcagatcatgaggtcaggagttcaagaccagcctgaccaacatggtgaaaccctgtytytactaaaaatmcmacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctraaatttatcggagaaaacaatt

SEQ ID NO: 634 - DNA, 401 bp, Homo sapiens
attttaaaggcccttgaaaacaaaataattatcttattaaaatttagttacatgttgtgtttaaaatgctaaagttttggccagcygcagtggctcacgcctgtaatcccagtactttgcccgagatgggcagatcatgaggtcaggagttcaagaccagcctgaccaacatggtgaaaccctgtytytactaaaaatmcmacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctraaatttatcggagaaaacaattgg

SEQ ID NO: 635 - DNA, 401 bp, Homo sapiens
aaaccctgtytytactaaaaatmcmacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctraaatttatcggagaaaacaattgggatctatttttagtctcaaatgtaggcatatacaaaaataatacatagtagttttctaagtactattagacatttgtttcccattttgccatttgctttcagtttacctgacatgaagataaaaatgatagctatttctcacttggcatttgaaagacaagagcaataagaaaccc

SEQ ID NO: 636 - DNA, 401 bp, Homo sapiens
tgctctgtaacatgattaagggcaattaacattgcaggtagaattaaagttactattttagtccatttgtgctgctataacaaaatgcctgagactgggtatgtataaagaacagaaatttgttttctgttctggagcctaggaagtccaagatcaaagtgccagcaggttccatcatctggtgagtactgcatcttcagrggggaggggaaaggaacagtatgttctcacctggcagaagaacaaaagagcaagctaccaaacactgccaagcctcttttatagaggccttaatcgcattcgtgagggagcagccctcatggcctaattacctcttaaaggctctatctcttaaaactactaggttggcaacacctgaatttaagagggggcataatcaa

SEQ ID NO: 637 - DNA, 401 bp, Homo sapiens
taataatttgtcaaggcagcaataaaaaaccaatgcagcaaaagacaataacgtctgtttaaccacacagtcacggaacatctattaactagcaacttattaaatacagcttactgctgcaacatctttggtgtaattaaaacatcctccatgaatcagagtgagaattatacttaagtgtctgccaattgccatgataakagaaaagcttatgatctctctactaagtaccttaggaagacaagggcccaatgatatgagcagtgtggtggaaccccaaacatcttcccactttcatgcacacatatcattcattctcctttttcccaaggttcgctgttagtatagaggcacaatagatcatgattagctctgggcatgttcacagtttagctgcctga

SEQ ID NO: 638 - DNA, 401 bp, Homo sapiens
atgccgcaaaaagtaaatgtttactccaagccaggtgcttggactctaaagaactctattaggcaagagtaagtggtttaattggctcaccttcattcaactgttagtatgttcctcataagtgcctgtcagagagaatcttttgtgtttcccttctaacagctggctcataaaaacataaactcatcttacaatgttaartaaggatcttttaattcctgttttctttcctccaatttgtattaatatgataggagagaaagaaagtgaaagcatgcttctatagctggctacttcatcaaacttaatggaaccatattttgtaattcattctataatttaagttttggtcattttatctcttaaagatgaattccaggccaggtgcagtggtttgtgcc

SEQ ID NO: 639 - DNA, 401 bp, Homo sapiens
ggtgtgatggtatatgcctgtagtcctagctactcaggaggctgaagtgggaggattgcttgagcccaggaggtccaggttgcagagagccatgatgatgccattgcactccagcctaggcaacagagcgagacactgtctcaaaagacacacaaacaaaaaaatatgaaaccctagctaaacactgtggactcaaaatamcctgtgaaatcacccaaccgtagtatttatctatgagaatgtttcaaagggagatatgtagttgtatgactatttcacgcagatatttgttattaataaaagactttgtggtcagcatgacgtgttagctacagttgaatccatgcttctttacattttgtggtttggttgttgtcgaatttactttccatgcattattt

SEQ ID NO: 640 - DNA, 401 bp, Homo sapiens
aaaagtttatgactagttgggtttggtctccattttgtattaatgtagttgggttcagtctccaatctgtatgtatgtagtttcctatcccagagagcaggacaagaccatataagctctatttatgtttcctttgactctttagctgaaagcctaggatgtaggacaagtggctaacctgttttagaactttcttcctasgctaacattctgaacttggccttgtggattttacctcttaaactgcaccaaaaaccatggaaacaaagggcttacagcagtgttagcctaatctgagccctctataccttcctatactgtggccacagcagtaaagctacgtggtcttgcaaaagaccttccaagagaaggttggctacagaccttgcttatcacaccat

SEQ ID NO: 641 - DNA, 401 bp, Homo sapiens
tgaaccctactctgttgggtggaatgtgtgtgtatctgcacgtgtgtgtgtgtgtgtgtgtgtgtgtgtgtttagaaattcaaaaaaaatgaggagatcttggtcttccatagagggaagactgcattatcaatagagtctttcttagcagaggatgaaggctcctgtagctcctaatcttcccatttgtgcacaaatacstgaattctgattaggttgaaatcaggaagacactcttttgctgcttagtggccacatctagagctaacaacattatcagtgggatggtgattcatggtttaagaacataccctcgccattccagctactcgggaagctgaggtaaaaggatcgcttgagcccagagtttaaggctgtagtgtgccatggtaacacataac

SEQ ID NO: 642 - DNA, 401 bp, Homo sapiens
tcattgatggtgtgtgatttcacaagctggattttatttcagaacacctgtcaaattcagagctgtctgaagcttctccaacatcattaccccagggctcccagttctatgcacatgtttttataatggcaggaaaaagaattcatatacgcatttgtgtgttagaatcagtggtgtgctggtgtaacaatcagctcctaragggtgaggcagggtgggtaggggatgtttagaaaaagtgggtatggagaagtccctgaattctagtttttgccaaattctgtgatgcaaatactcccaccacagccaatttcaaggttatttttcccagttacatttaatcagggccatacaagatgttacaagaaagaaaatgacaggaacccatgtggttcaactga

SEQ ID NO: 643 - DNA, 401 bp, Homo sapiens
acattttgcatccctttttgatgtctacaaatgtggcatttgtcagatgtgagatagttaagtgtgtgtgtgtgtgtgtgtgtgtgtatatatatactttatatatgtatatatacatatcctatgtgtgtgggtatatatatatatatatatatatatatatatatatatgaatgatgcatggagagatatctcttcccwtgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataactccgactaatagaactcattgcttttccagtt

SEQ ID NO: 644 - DNA, 401 bp, Homo sapiens
ggcttttggacaaataacaggcagattctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctargccatawtgaggaaggccaatgcarktttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctc

SEQ ID NO: 645 - DNA, 401 bp, Homo sapiens
ggacaaataacaggcagattctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctargccatawtgaggaaggccaatgcarktttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttcca

SEQ ID NO: 646 - DNA, 401 bp, Homo sapiens
ttctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctargccatawtgaggaaggccaatgcarktttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttccacttcctgccttccccagt

SEQ ID NO: 647 - DNA, 401 bp, Homo sapiens
tctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctargccatawtgaggaaggccaatgcarktttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttccacttcctgccttccccagtc

SEQ ID NO: 648 - DNA, 401 bp, Homo sapiens
ctggatcccttccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaaytaaagagsttmtgcacagcmaaagaaactaccatcagagtaaacaggcagcctacagaatgggagaaaatttttgcaatctattcatctgtcaaagggctaatatccagaatmtaacagtgaactcaaacaaatttacaagaaaaaaacaaacaaccccatcaaaaagtgggtgaaggatatgaacagacacttctcaaa

SEQ ID NO: 649 - DNA, 401 bp, Homo sapiens
cttccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaaytaaagagsttmtgcacagcmaaagaaactaccatcagagtaaacaggcagcctacagaatgggagaaaatttttgcaatctattcatctgtcaaagggctaatatccagaatmtaacagtgaactcaaacaaatttacaagaaaaaaacaaacaaccccatcaaaaagtgggtgaaggatatgaacagacacttctcaaaagaagaca

SEQ ID NO: 650 - DNA, 401 bp, Homo sapiens
ccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaaytaaagagsttmtgcacagcmaaagaaactaccatcagagtaaacaggcagcctacagaatgggagaaaatttttgcaatctattcatctgtcaaagggctaatatccagaatmtaacagtgaactcaaacaaatttacaagaaaaaaacaaacaaccccatcaaaaagtgggtgaaggatatgaacagacacttctcaaaagaagacattt

SEQ ID NO: 651 - DNA, 401 bp, Homo sapiens
ttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaaytaaagagsttmtgcacagcmaaagaaactaccatcagagtaaacaggcagcctacagaatgggagaaaatttttgcaatctattcatctgtcaaagggctaatatccagaatmtaacagtgaactcaaacaaatttacaagaaaaaaacaaacaaccccatcaaaaagtgggtgaaggatatgaacagacacttctcaaaagaagacatttatgcaacca

SEQ ID NO: 652 - DNA, 401 bp, Homo sapiens
gacataggcatggacaaggacttcatgtctaaaacaccaaaagcaatggcaacaaaagccaaaattgacaaatgcgatctaattaaaytaaagagsttmtgcacagcmaaagaaactaccatcagagtaaacaggcagcctacagaatgggagaaaatttttgcaatctattcatctgtcaaagggctaatatccagaatmtaacagtgaactcaaacaaatttacaagaaaaaaacaaacaaccccatcaaaaagtgggtgaaggatatgaacagacacttctcaaaagaagacatttatgcaaccaaaagacacatgaaaaaatgctcatcatcactggccatcagagaaatgcaaatcaaaaccacaatgagataccatctcacaccagttagaatgg

SEQ ID NO: 653 - DNA, 401 bp, Homo sapiens
cccatttcattctgaaggtcaaggacaacttaggtaaagggcagtgactaagaaagaccaccctggtcaggctcgatggctcacccctgtaatccaagcactttgggaggctgaggcaggcagatcacttgaggttagcagttagagaccagcctgaccaatatggtgaaaccctgtctctactaaaaatacaaaaattarctgggtgtggtggtgcaagcctgtaatcccagctgctctggaggctgaggcaggagaatcacttgaaccctggaggtggaggttgcagtgagccaagattgcatcattgcactgcagcctaggtgatagagtgagactctgtctcaaaaaaatagaaagatcattctggcttttgggtggagaatagactgtccatgggc

SEQ ID NO: 654 - DNA, 401 bp, Homo sapiens
aaagccagggttgttaagtagtatgtctcaatcaacatactcaaagtctgtgaaccaaaggcatagtcttaggcttcctcttatagtctagcatgatattattctatttcatctttttttatatgtttgctcccttgagtgttttagaatgagactgctagattttatgtttctaaagctggttttctaccaggcctgttytcagaacattctttttttttttttttttttttttttttttttttwaagatagagtcttactctgtcacccargctggagtgcagtggcgcgatcttggctcactgcaaccttcgcctcccgggttcaaacgattctcctgcctcagcctcctgagtagctggaattacaggcgcccaccactaaccccatctaatttttg

SEQ ID NO: 655 - DNA, 401 bp, Homo sapiens
gtctgtgaaccaaaggcatagtcttaggcttcctcttatagtctagcatgatattattctatttcatctttttttatatgtttgctcccttgagtgttttagaatgagactgctagattttatgtttctaaagctggttttctaccaggcctgttytcagaacattctttttttttttttttttttttttttttttttttwaagatagagtcttactctgtcacccargctggagtgcagtggcgcgatcttggctcactgcaaccttcgcctcccgggttcaaacgattctcctgcctcagcctcctgagtagctggaattacaggcgcccaccactaaccccatctaatttttgtattttttagtacaaaatgggatttcgccataatggccaggctgg

SEQ ID NO: 656 - DNA, 401 bp, Homo sapiens
gcttcctcttatagtctagcatgatattattctatttcatctttttttatatgtttgctcccttgagtgttttagaatgagactgctagattttatgtttctaaagctggttttctaccaggcctgttytcagaacattctttttttttttttttttttttttttttttttttwaagatagagtcttactctgtcacccargctggagtgcagtggcgcgatcttggctcactgcaaccttcgcctcccgggttcaaacgattctcctgcctcagcctcctgagtagctggaattacaggcgcccaccactaaccccatctaatttttgtattttttagtacaaaatgggatttcgccataatggccaggctggtctcaaacacctgacctcaggtgatct

SEQ ID NO: 657 - DNA, 401 bp, Homo sapiens
tatgcatccctcaatcccctccctcttctgcatattttgaacttgcaaagccttctgatattttaagcagaaggttgcaaatgcttgtcctactgcctggccaagtcttaggtaaaaattgtcacctaaccacatcctcagatcatttcccctgtactctagatcactaagcgcatgtgcacacacacgcatgcacgcgcrcacacacacacacacaccatccaggatcctcctgaggatgaatgaatattcctgggccaaatattgcatgaggatttgggcaatgttttggctagttgaacaacaacaatgctcatatttatgccaattggcaggaccattgcttgatcatcctgtacttggtgaagggcattttttattgtttccttttttgtttgttt

SEQ ID NO: 658 - DNA, 401 bp, Homo sapiens
taaattagttaatgacagggctctcttattcttaaacctgtcatttcccctaaactatgttgttttcctaaagtgagattaaaagtttgaaaacaaaggaacaaaatgttcatttatttactacgtttctgaaaacttgcatatatcttaatatatatatatatcttatttatatgtcttatttcattgttatgaaaacckagctttctttccttctatcctttcaatattatgctacttgtatttagtatttacattgtatgattcaaaatattgttcactgcagagccaagtagtagactatgaccgctctgcttattttgaacaatcttttatttttttctggagttgataattgcttcagatttttgtctggctttttataagcctgttgataattt

SEQ ID NO: 659 - DNA, 401 bp, Homo sapiens
taaaattctctcattgttttaaactttttttttgagtggagtttcactctttttgcccatgctggagtgcaatgacacgatcttagttcactgcaacctccgcctcctgggttcatgtgattctactgcctcagcctcctgagtagctgggattacaggtgcgcaccatcatgcccaactaattttgtattttttgtagakacaggatttcaccatgttggccaggctggtctcaaactcctgacctcagatgatctgcccgtctcagcctcccaaagggctgggattacaggcattagccactgcacccggcctgttttaaacatttaatggactcaccagggaattttcttgtcttattactttgataatttcctccactccattttccctctaatatt

SEQ ID NO: 660 - DNA, 401 bp, Homo sapiens
tttttttttttttaggactagatggaggtaagggaaagtgtgagacaataaaactggcaaccagaaacagaagaagaaaggaagagagaaaggaatctacggagtgtggaagttttaggagtaaatttctatataagttgcaaaattttagtaattctttagttcttatttcatttattcacttattttttttttcttttkagacagagcctcactttgtctggagtgcagtggtgcaatcttggctcatgcaacctctgtctcccagcttcaagcagttctcctgcctcagcctccccagtagctgggactacaggcaccagctaactttttttatttttagtagagatgggatttcaccgggttggccaggctggtctcgaactcctgacctcaagtga

SEQ ID NO: 661 - DNA, 401 bp, Homo sapiens
ctattagggaaaatacacgaaaacaaatataaaacaataacaaattaagtaactaattaaataatgtgtggcatggaaataaatgaaatactgtgcaaccttcgaacaccattttatagaacaaataatcattggagaagtagacgtgatatgttgttaagtaaacatatcatataaatggcttagaggcttagagatgtrtaggaaaggaaatactctaaaatgttaacaagaatggtatctctggtgcaattaaaagtctttttaatttggatgggtttttttatattttacaaatatttctgcattgattctacattacttatgtaatcaaaggtgcccaatacgtgttacttaaagaatctcttcaataattagaacgtaggcactcaatgctcatt

SEQ ID NO: 662 - DNA, 401 bp, Homo sapiens
tagcagagagctcatgatcgtccatctaactcccacaccatcttggagagccacagggtatcctacattatcctgctgaagatccttcagtacctaatggctctcgtgaagcattccaaagtgaaagtcatggagcctatgccactaaatcagatataactagatacatgttggattaaaaggaaaggaggaaaggcatakaagggaaaaacagagattattggagaccaaatacctctataaattctcaaaatttgtttaaaggctttactttttcaagatgcatattttggcaatagcttacgaagactgaagttttcttatttaatcttagagatactaatacttagaaaagaaaagtcttctatcttgttgaccttctctgtagccatttgaaatct

SEQ ID NO: 663 - DNA, 401 bp, Homo sapiens
gtattatattggtgcaaaagtaatgcagtttctgccatttctcttaatgccattactcgtaagggcagaaatgaccattacttttgcatcaacctaatacctccagattttagatatttgagtgccattgcttgatatatcttttgttttttcttctggaaattttggttactttagttgcataaaggatgacttccattwtaccctgttaagcatctctgtctggtcagaagctactactctgttctttctagttcagtagggaacaatcagtttccttctcaattttcagctaatctttatgaatgaaatttgattaaatctagcaaaactatgcaaacatcataacagcatatggggagccttcctgtagtaccagtgggctatttccgtctaataac

SEQ ID NO: 664 - DNA, 401 bp, Homo sapiens
cttcctgtagtaccagtgggctatttccgtctaataacagattcaaaaaatccaattagacagtttgaaaaaagaaagccagagttaaaaatatctgactgtttgactgagaacagcagggaatggtttataggccaatcatttatggtgaataggatcttagtggtgagcaactcacatctctagcccattagaataatktgttactcatattgctcctaaagctttctacttaattataccaagttaaatagcagacattctcactcccttttgatggaaaatcacatttattcacccacacaataccatccttgggtgttaagggatgagagttgacctaatgggaagacaaacaaatggtttaggaaatgagacatgatttttttacacaaaggtta

SEQ ID NO: 665 - DNA, 401 bp, Homo sapiens
gccaggctggtcttaaactcctaacctcaggtgatccgcccacgtcggcctcccaaagtgctgggattacaggcgtgaaccaccgggcccagccaagtgttttaatttttaaaaactatttgaccatatgaaaatatagatgttccattaaatatatatagcctaagaaatataatcagcaatgcagtaaaagattatgtrtacggatgctcctgacagttggatttacaatagggaaaagctggaaacaacctaaatatttgaaaaaagagaatggtaaatacatcaaaaatacaataaatacagtgttaagtgaaaagtttgtgcaattttgacttgagaaatttttaatgtactatgactacttggaagaatatggatgtacctcaaaataagtaatg

SEQ ID NO: 666 - DNA, 401 bp, Homo sapiens
taaaatgggttatacctatcatttttttcatattagaaattaaaactgagaaatgtttgaacacaggaatacccaagtacatattccagtgatcagcagagcaatggcatcatcacatcatattgcctccagaaaatcccactgacaatttgttgaagactaaaagggaaaaagccaaacaccttagtatgctgtaaaaayagctttcatctcacagacctcccgaaagggtcttgaagatccatgagcaatccctggaccacactttgagaaccgcttttgtaacgtgtgaccttcccttatcctctgccatgcraaactatctcagaatctaagattgtctacagccacggtacaaccagctctgagactttgaagagaagaaaagatgaacttcatca

SEQ ID NO: 667 - DNA, 401 bp, Homo sapiens
catcatattgcctccagaaaatcccactgacaatttgttgaagactaaaagggaaaaagccaaacaccttagtatgctgtaaaaayagctttcatctcacagacctcccgaaagggtcttgaagatccatgagcaatccctggaccacactttgagaaccgcttttgtaacgtgtgaccttcccttatcctctgccatgcraaactatctcagaatctaagattgtctacagccacggtacaaccagctctgagactttgaagagaagaaaagatgaacttcatcactaaaaaagccaaagtagttgaaagcaaacactagcygaattttcttcctccaagcctacagaccacctcacgtagtagctgtagtgggagctgctcccaagatttgataagaat

SEQ ID NO: 668 - DNA, 401 bp, Homo sapiens
agatccatgagcaatccctggaccacactttgagaaccgcttttgtaacgtgtgaccttcccttatcctctgccatgcraaactatctcagaatctaagattgtctacagccacggtacaaccagctctgagactttgaagagaagaaaagatgaacttcatcactaaaaaagccaaagtagttgaaagcaaacactagcygaattttcttcctccaagcctacagaccacctcacgtagtagctgtagtgggagctgctcccaagatttgataagaattagtaaagaggtttataagaccgtgtgtgcagagtctcacagttgctgatacttgttgggcttagctttatctctgtctacagtagcagcccaggacaaaacattcatatgatattctctct

SEQ ID NO: 669 - DNA, 401 bp, Homo sapiens
catttctcagagataactgtgttagcattttggtgtgtttcttatagccctttttgttgtcaaaaataagcaaagataaaggggaaagattttgttctgtttcttttttctatatacacagtatatcttggagatagtttcaagtgccaaatacatgcatttatttttttcacagaatgcaagtcatgtcatagcatggaygaagttgggtttatttaatcattcactagttggcaggtatttaggttgtttacagtttttccattttagaaacagtgttcccatgtaaagaatgtcccttgtgcataaatcgttgtgacatgtgttggaatctcaaaagtggaattgctgagccaggggcatcctcattttaaaatttaatagacatcatcattatcctc

SEQ ID NO: 670 - DNA, 401 bp, Homo sapiens
ttgccacctttaacacagggatattaggtaacttaagaggtaaatgtgtgtttcttgaatcccagatctaccacttaaaaattatgtaaggtttgatttactgattcatttttcctgccccaccaacttcatgaccataaaataggggcaggggagaaggaaatgataagacttagcatattataccatatggaaattaartaatacacataaaatacttaaaatagygtcaggcaatttaagagcactcagtaaagttagctcttattaaatttttgcaactccatgtatacctgggatctgtttctggtttgttcatggcagcattgtcaactaaaactttctgtgctattcagtgtgatagttattggacacaatgaccactgaaaacatggctagaa

SEQ ID NO: 671 - DNA, 401 bp, Homo sapiens
gtaacttaagaggtaaatgtgtgtttcttgaatcccagatctaccacttaaaaattatgtaaggtttgatttactgattcatttttcctgccccaccaacttcatgaccataaaataggggcaggggagaaggaaatgataagacttagcatattataccatatggaaattaartaatacacataaaatacttaaaatagygtcaggcaatttaagagcactcagtaaagttagctcttattaaatttttgcaactccatgtatacctgggatctgtttctggtttgttcatggcagcattgtcaactaaaactttctgtgctattcagtgtgatagttattggacacaatgaccactgaaaacatggctagaatgatgggaaaattaaaattttaattaa

SEQ ID NO: 672 - DNA, 401 bp, Homo sapiens
tattaaatttttgcaactccatgtatacctgggatctgtttctggtttgttcatggcagcattgtcaactaaaactttctgtgctattcagtgtgatagttattggacacaatgaccactgaaaacatggctagaatgatgggaaaattaaaattttaattaattttaatttaaagataaacagccacatgtggtcagtargtaccatattggacaggagaatgcccatatagtattttccatgagctttcatgagttatgctttattatataaaccagattttatttaagaactcatatggactagattatgaattttatgagatgattttccttgagtcatcaagaagaacacagtttttttctttaatctgttaaagttgggaagtattaatataaat

SEQ ID NO: 673 - DNA, 401 bp, Homo sapiens
tagttcctacttgaaatcaacattccagcaataaaccttattggttcttgttattctttgacctcacggttaaatttgatttgctaattttggttagagctcttctatattcatatttgagattattttaaatttgcattgtgcattgactgtgagatgagtattttgttggcttggtaaaatgaattaggagacttcatrttctaaattctgaaatagtttgaatattggagttattatctgttcttgggagatggtttttatcaccagttcccctaaactcctttttaccttgaggtaaagcaaagtctaccttactatttcttgtatggtgattggctattcaggttttctatctattattaagacaattttgaactcactggtgctccaaagaaaat

SEQ ID NO: 674 - DNA, 401 bp, Homo sapiens
aggttcagcaacttgcccaaggtctcacagttgtaagggacagagtctgaatctattgcctctatacttaatcaataaagattcattatatgcattagctcatcaaaggttctaagatgtctagagtaaggaaaatttttgactttgtttaaataaccatttcctggaagcaccatcgaaaacattggtagttgcagggtrcagtggctcacacctgtaatcccagcaatttgggagaccaaggcaagaggataacttgagcccaggagttcaagccccatctggccaacatggtgaaaacccgtttctactaaaaatacaaaaactagccaggctggtggtgtgtgcctgtagtcccagctacttgggagtttgaggcaggagaattgcttgaacctggg

SEQ ID NO: 675 - DNA, 401 bp, Homo sapiens
gaaaacccgtttctactaaaaatacaaaaactagccaggctggtggtgtgtgcctgtagtcccagctacttgggagtttgaggcaggagaattgcttgaacctgggaagcagaggttgcagtgagccgatatcatgccactgcactccagcctgggagacagagcaagactctgtctcaaaaaaaaaagaaaaataaaggkrgggtgttttatatttatatctacataaatctatacattatctagatattatactatattatggaaatgtatatattatattagaattaatatttctaattatcgtatacagttatacattttattgtgttattataacatattatatataatwggttctgtttttctgaagagccataaataatgcattcaatttagaa

SEQ ID NO: 676 - DNA, 401 bp, Homo sapiens
aaaacccgtttctactaaaaatacaaaaactagccaggctggtggtgtgtgcctgtagtcccagctacttgggagtttgaggcaggagaattgcttgaacctgggaagcagaggttgcagtgagccgatatcatgccactgcactccagcctgggagacagagcaagactctgtctcaaaaaaaaaagaaaaataaaggkrgggtgttttatatttatatctacataaatctatacattatctagatattatactatattatggaaatgtatatattatattagaattaatatttctaattatcgtatacagttatacattttattgtgttattataacatattatatataatwggttctgtttttctgaagagccataaataatgcattcaatttagaag

SEQ ID NO: 677 - DNA, 401 bp, Homo sapiens
ggagacagagcaagactctgtctcaaaaaaaaaagaaaaataaaggkrgggtgttttatatttatatctacataaatctatacattatctagatattatactatattatggaaatgtatatattatattagaattaatatttctaattatcgtatacagttatacattttattgtgttattataacatattatatataatwggttctgtttttctgaagagccataaataatgcattcaatttagaagacaaactcttttagttggaatgagcctaataaaaataattaccatcccaagccaactttaggttattatttgtctctgacagtattaaattatcattatattaaattcctagaagcactatagaaatggcagcagagtatttatattatatat

SEQ ID NO: 678 - DNA, 401 bp, Homo sapiens
agagtatttatattatatataatataggttatattattagatattaatatattacattacaattgtattatcatgatattatatataaattggttctgtttctcttgacaaccttactaatacatccagtttagaacataaattctattagttggaatgagcctataaaaataattaccattccaaaccaactttaggttrtcatttgtctttgatattattaaattattattattttaagttcctaggagcacaatagaaatgctggcagagtgtttatattaaatataatataaattatatttttagatgtaaatatattactttatgatgacattattgtgatatatatataatataatgagttctttttccctggagaaccttaactaatacatcta

SEQ ID NO: 679 - DNA, 401 bp, Homo sapiens
agaaaagggagaggtaaaagctcccaggaaagtctagtgcccagccaaaggccatgggagtgatgagtgaccctgcccacacctaacggagcgtcccctgctctgctagtcagtcaacagaacaccagccaatttctctaagccaagagctggttatttccaacctcccctggaagagtttacttaataccataagaagtmattttctcttccatctactgcaagaaaaaactggatattgcaattgccatcctttttgagttaaaatactctacatttttaaacaaataaataaaaaagcttaaccattttgaaattaccagtagggaagaaatcgggtgaaaaaggagaggaaccatgcattactgagaatactcctgtcccaaatctctctccatatc

SEQ ID NO: 680 - DNA, 401 bp, Homo sapiens
tgtataccttaccacctatttgaaaaatgatggatagttatcttaaacggtgaagaattagtgtaagttcttaaacaaaatagtggcgatattaagatcatgcttgagaaacctaattcttgctgtctccttacatattttaagtttggcctaactctgtctctgtgcatagtgagctgtaatgtaactggatgtgtaaayagattgtagcctactcttgtgccaatctccaagttttggccaatcaaaggtggccaaccattcaaaccatgttcaagtaaggcaaacatcaagctgtaaccaacccaactatttttgtaccttgcttccattttccatatgtcacttttctttttctgttcataaattctctcctaccacgtggcatcacgggggtgctc

SEQ ID NO: 681 - DNA, 401 bp, Homo sapiens
ttgtaccttgcttccattttccatatgtcacttttctttttctgttcataaattctctcctaccacgtggcatcacgggggtgctctgaacctcttctggttctggggctgatccattcatgactcattctttgctcaattaaagtctgataatttaatttgtctaaagttttccttttaacacgaccaagagtcacagaytgcttagtctggagaagctactcttggctctatgcagtccacaaaaaatgacatttagaaatggttttccttccctggtctccagagaagcagcggctttcatactctgaaatgcagcatcctcatctgtaagatgcaggtgctaaatgatgactgttgttctttcaaatgttaactttctatgagtcacttcttcattg

SEQ ID NO: 682 - DNA, 401 bp, Homo sapiens
tttcatactctgaaatgcagcatcctcatctgtaagatgcaggtgctaaatgatgactgttgttctttcaaatgttaactttctatgagtcacttcttcattgtatgtgtcaagaagcacaacctcgaaagcctgcctttgacaatgcttagaggttagaggatgccaaatgagcctcatcttctttggctactgagttartaaccatccttcatttatctcagggagcaaaggcaggatttccgtgggtgtccaaggtccttactcacagtcaggatgcatggcagtacccttaataactacagattcagaatcacagaagacatttaccgartatgtattttctgccaaaccctgtgccaggtgttattagaacattacttatgaaatatttggtagtg

SEQ ID NO: 683 - DNA, 401 bp, Homo sapiens
tgcctttgacaatgcttagaggttagaggatgccaaatgagcctcatcttctttggctactgagttartaaccatccttcatttatctcagggagcaaaggcaggatttccgtgggtgtccaaggtccttactcacagtcaggatgcatggcagtacccttaataactacagattcagaatcacagaagacatttaccgartatgtattttctgccaaaccctgtgccaggtgttattagaacattacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaatt

SEQ ID NO: 684 - DNA, 401 bp, Homo sapiens
aacattacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaattcacatctgagttggttgcatgatgctatagttggcaacaygattctgaccgccaccatcacaaatagaggttagaaaatattacttatgtgaaaataaatgccatttctggcacctaaaacagctcttttctcaccttcctatgatgaggttttattgagcttttgcaggaaagaaaagaaagaaatctgcattcaggtttcaggagtaaagaggctgctcattaacaaagccgtttcaa

SEQ ID NO: 685 - DNA, 401 bp, Homo sapiens
accacgaatacatgccctattactaaaatcactgtcatttctatgcttttcttctcccttcaatcacataccacccagttttcagttcctataattgccaaaagccatttatgaatctgccttattgtatgggttacaaacgtctattttcctgctctgttcatacacatttgggagcaccttaagatgctgaaacactgrcaaatgcttaatatatttcatttgaaagaattatgatctaaatcttaaagaaacagtgagtaaagtgcagtttctgctgcttggttactgtagttcattcggggaatttcatcttggtcgtgttgaatgcagtggttagatcctgtgaagttgtttaattaaaggtgttctagtagtcaaagccatgtctaaaaccccgt

SEQ ID NO: 686 - DNA, 401 bp, Homo sapiens
gaatatttcttatctatatgcatatatatatatatttcattataattgttgcttctgcagaaaattgggatagaaatctcagatgagctgtagttacacggagatctacagcaatgcaatgtttagctagcatgcattttgtcatccaaggctagtaggtgaaatatttcctttacctgtcttgatgcacggtggagaaakgagacccgcttcgttttccctctaatctagagagttaacctcctccaggtagggttgaaaatatgaacagagctgcttttgcaagactgtgttgcctctaaatgtgatttaactcgcatattcagaatcttagcaaaaataaataaataaatagtaagatggggtaaggcaaatacatagatattttggagatcttatcc

SEQ ID NO: 687 - DNA, 401 bp, Homo sapiens
caggtagggttgaaaatatgaacagagctgcttttgcaagactgtgttgcctctaaatgtgatttaactcgcatattcagaatcttagcaaaaataaataaataaatagtaagatggggtaaggcaaatacatagatattttggagatcttatcccttattcaaggactgtagattattacagctttgttgtcatattatytctaggcagtaaatcatagtaaagtagtaaattcatagggaatgaattaatctcctttttgttttgttttctctgaaaaagagggtgtgattacagcatatattgattgggtactgattatgggacattttcattgtatttgttgttgttgcagtagactaaatgtcgagcccgtgaatctcttgtgttggcattgtcag

SEQ ID NO: 688 - DNA, 401 bp, Homo sapiens
tatatctttatattttttttgctctcttctcaaccatgtttagtgttttgtttatattcaaaggattttattttcacacttacaattctttacttgtctgtcattcaaatctttgttaccaaaacagtttgctctttttcatcattcactaagcattcctttcacagctaagctaaagtgtctatatggaaacatacatayacacacacacacacacacacacacacacatgcacacacactttttccaggccacagacaggaagatatgtgtaaatgtatacatgttttcagtagcatatatacacaagggtctccaataagatttttctagaaacaaaggctgatactacttcatttcatattattgtaaagtgctaattctaagtaaaagtagactaa

SEQ ID NO: 689 - DNA, 401 bp, Homo sapiens
ttttctctgccatctcccccagttacacccagggcaagtctatcttcttcaaagacattcagtcagcccacagctttttatcttttcaaacctttaatggcaccattagctacggaaccttgatttccttaatttttcccccactgtcactgcaaccatcacatgtggctctcagagcttctagttccctggaaacaggakttctatctgccatcaccaggtataaggtgccaccacttgaagggatctgccctatcaaaaatgaggaaatatattgatcaaaatggctggagaaagtgaccagccaaaacacagcttcacagtcttgcctgttttaagtagattctatttccattttgccggtgacagcactaagcaaataagcaatgttgccaatccga

SEQ ID NO: 690 - DNA, 401 bp, Homo sapiens
aaaacatcttccgtaataagcagctagaaagtaccacaatgtaaattcaactgcagaagacatgacaccacagggaaatttcgtttcactgcagcagtgtctaaaaactgaagatggggaaagtgtagagtgtgttattaaaatgattttttcaaaaggttttaagagtctaaataaattgcataattagtcagtttcctwcctcctagtcttcctacctttagtctttatttttagctctcctgagtttgtagttgttctccttccatggtttgattctctccttagctttcagattctatacatttcacttctctttataaataatttttaaaaattcttcatgtgaacctgttcaagaacctgttgcattgaggactgaagatatggctctagattcc

SEQ ID NO: 691 - DNA, 401 bp, Homo sapiens
cactttctgcatattgccaagggctcgctacgtatgtgtgttctggttggcagacattttgggtaactactattctcaatttgtacctactttatttcaatacatgtttcaagatgagtgttaaagggtacattgctttaggaaacttgtctttttctggcatttgaacttgcctaaattagaaaaaaaaattctggttcyagtcctttttttctaaaaaaatattccaaatcattagatgaaactgttaaagataacgtttggaaagtttgtctcctcttyggtgattaaaaagtgctttccatttttggcccatggctcttttcctggggcatagcatttgattataaagcttttctgatgaaagtatcacaggayagcaaacatgagaatgggagaaa

SEQ ID NO: 692 - DNA, 401 bp, Homo sapiens
tgtacctactttatttcaatacatgtttcaagatgagtgttaaagggtacattgctttaggaaacttgtctttttctggcatttgaacttgcctaaattagaaaaaaaaattctggttcyagtcctttttttctaaaaaaatattccaaatcattagatgaaactgttaaagataacgtttggaaagtttgtctcctcttyggtgattaaaaagtgctttccatttttggcccatggctcttttcctggggcatagcatttgattataaagcttttctgatgaaagtatcacaggayagcaaacatgagaatgggagaaataattttgcatgcaattttttgtcatctggctgcactgtatgggaaatacattttccctgtcaaaatgtcaagttgttttg

SEQ ID NO: 693 - DNA, 401 bp, Homo sapiens
attagaaaaaaaaattctggttcyagtcctttttttctaaaaaaatattccaaatcattagatgaaactgttaaagataacgtttggaaagtttgtctcctcttyggtgattaaaaagtgctttccatttttggcccatggctcttttcctggggcatagcatttgattataaagcttttctgatgaaagtatcacaggayagcaaacatgagaatgggagaaataattttgcatgcaattttttgtcatctggctgcactgtatgggaaatacattttccctgtcaaaatgtcaagttgttttgacttcacaacaaaagaggaaggaagttcttaaatgtagaacaataactcagctcactgctgatttctatttgttctatccttacatcacagtatag

SEQ ID NO: 694 - DNA, 401 bp, Homo sapiens
gcataattttgtttattgtttgagaaagtagtattttgggtaaaaattctgaaacaggcagtgagtatgtctgagtatttctggcaagggctatttcttcctttctccttttactctggagttttcttgaactgagctgtttggacaaatgacacatatttcaagaattccaactgtgggagtgtttcactcacaggattktgctttcttctaagagccaggtctggtgaacactctcaggagctttgtaacatgttccaagctatgcagaagtgcttagttcattcactagtcaaagactaacacatttacagcaataaaatgcattataagcattctttcttcatgaatctattcatcccattaaaaaagcaggaattccaattaagtgaggtaaaata

SEQ ID NO: 695 - DNA, 401 bp, Homo sapiens
ttccaattaagtgaggtaaaatatgctaagtagtacagtataagatttttaaaaattacaccatgtttttcatggattattttaagaaaaaaactattttaagaaaaaactgtcctatttttggaaggtctagtcccaaactgcacaggaaagttagaggtaaactgttaaagtctttgagaactggcatttttcaagccrcagtgaatgaaatcaagcattyctctgtttctcctttcctttcggaatttcttttcctgaggcttgagaaggcaatactggtcttacttttcacatgagtyaagtttatactagctgagcaccctgaatcattaacgtctttctccccaggggagaccaagctcaaatccatcatcagaatacatacttagaccctctcc

SEQ ID NO: 696 - DNA, 401 bp, Homo sapiens
atgctaagtagtacagtataagatttttaaaaattacaccatgtttttcatggattattttaagaaaaaaactattttaagaaaaaactgtcctatttttggaaggtctagtcccaaactgcacaggaaagttagaggtaaactgttaaagtctttgagaactggcatttttcaagccrcagtgaatgaaatcaagcattyctctgtttctcctttcctttcggaatttcttttcctgaggcttgagaaggcaatactggtcttacttttcacatgagtyaagtttatactagctgagcaccctgaatcattaacgtctttctccccaggggagaccaagctcaaatccatcatcagaatacatacttagaccctctcccttctttctggccccctgcttc

SEQ ID NO: 697 - DNA, 401 bp, Homo sapiens
agaaaaaactgtcctatttttggaaggtctagtcccaaactgcacaggaaagttagaggtaaactgttaaagtctttgagaactggcatttttcaagccrcagtgaatgaaatcaagcattyctctgtttctcctttcctttcggaatttcttttcctgaggcttgagaaggcaatactggtcttacttttcacatgagtyaagtttatactagctgagcaccctgaatcattaacgtctttctccccaggggagaccaagctcaaatccatcatcagaatacatacttagaccctctcccttctttctggccccctgcttcttaggaatgtgctctaaccaccacagcattcctgatcaccacctccagatgacaaaaagaaaaaatgagtggcagtgaa

SEQ ID NO: 698 - DNA, 401 bp, Homo sapiens
ctaaccaccacagcattcctgatcaccacctccagatgacaaaaagaaaaaatgagtggcagtgaaccagaagagcttaggccatctattttatcctaaaatctgttcagaaatacgaggtttgtatcaattagtaagcacactgggaatacaggtatacaagttgttagcaatatttggttatataatgtctatagatayttattttgctttctctcagatattaagaattatgtctttcctttaacctccatcatttgtttttctactttggtggaagctttttgtttgtwtctttactgcaacagtgaatttatccttggatttctccattatgattggcagtatttatacaataatttcttggtattagttaattgataccttatatttactatttt

SEQ ID NO: 699 - DNA, 401 bp, Homo sapiens
atcctaaaatctgttcagaaatacgaggtttgtatcaattagtaagcacactgggaatacaggtatacaagttgttagcaatatttggttatataatgtctatagatayttattttgctttctctcagatattaagaattatgtctttcctttaacctccatcatttgtttttctactttggtggaagctttttgtttgtwtctttactgcaacagtgaatttatccttggatttctccattatgattggcagtatttatacaataatttcttggtattagttaattgataccttatatttactattttcccccaaagctgagtaaagaatagaatgaaatggcctatacttatcagtgtaaatggatattagaattgctgctcttattccaaaaaatakc

SEQ ID NO: 700 - DNA, 401 bp, Homo sapiens
twtctttactgcaacagtgaatttatccttggatttctccattatgattggcagtatttatacaataatttcttggtattagttaattgataccttatatttactattttcccccaaagctgagtaaagaatagaatgaaatggcctatacttatcagtgtaaatggatattagaattgctgctcttattccaaaaaatakcactyaaagttcacaaatgaaagttaataactgaattttagtaacaacaacttcaacttaaaaaattccatgtaattaatagctcatgagtcccactgagataggttgaacttcataacttctaaagccttttatgtttctactacttttcagttctaatgttcaatagtagcgtgagtatctggttagtttcagtataa

SEQ ID NO: 701 - DNA, 401 bp, Homo sapiens
ttactgcaacagtgaatttatccttggatttctccattatgattggcagtatttatacaataatttcttggtattagttaattgataccttatatttactattttcccccaaagctgagtaaagaatagaatgaaatggcctatacttatcagtgtaaatggatattagaattgctgctcttattccaaaaaatakcactyaaagttcacaaatgaaagttaataactgaattttagtaacaacaacttcaacttaaaaaattccatgtaattaatagctcatgagtcccactgagataggttgaacttcataacttctaaagccttttatgtttctactacttttcagttctaatgttcaatagtagcgtgagtatctggttagtttcagtataaaaaag

SEQ ID NO: 702 - DNA, 401 bp, Homo sapiens
ggtggatggcactgctcattagaaatagctgtcctgccccagaacaatcttcaagacaaaggttgcaagactatctttgaccttcctgtccctaaacactccccaaccccaagccaaacacgcgcctaaaagttttcacaccttgccctttactaacagcaatcatatttaggaggaatatattattgttagtcaggaaaytctacctggcttcaggaggtagcttagtgggtatttgctaagtctgatacctttcctttcaacatttagctgagattacctatactaagagcacgaactacaactgtggaaaacagaagaaaggagaatgttctccaaatcaaagtgtgctaaggtcagcttggggcagccaacaattcctggaaggtgacagagataaa

SEQ ID NO: 703 - DNA, 401 bp, Homo sapiens
tggaagaaaaaacaagagtataaatgaagtgtcaaagatgttaagaaacaggatcttttaaaaaattatttttaattattatgggtacataataagtgtatatatacatggggtacatgtgaaattttgatacatacaatgtataataatcttatcggggcaattggggtgtccatcacctcaggcatttatcatgtcttrtattagaaacagtccaattctcctcttttagctatttgaaaatatacaataaattattgttgagtatcatcactctgttgtgctatcaaatactagatcttattctttctatctaactatgcttttgcacccattaaccatccccaccttctccccatgctggctatccttcctagcctctggaaaccatcattctatta

SEQ ID NO: 704 - DNA, 401 bp, Homo sapiens
agaacattattaacttgaaagaaatgcatgtattttgttaattgatagaaacaagatcaaagggcatattatattattattccgctttgtaaggaaaaataggttttgcatatttatataaaaagggaaattgaatgtgatatactctggggtattaataataattgtgaattaaattcctttctttagtttatattgctrtctcaaatcttctgatttttctaccttgaatgtaaattttttgtttgtaatatggcactttaaattaaagttgtttttcagctgggcacagtggctcacacctgtaatcctagcactttgggagaccaaggtgggtggattacctgaggtcaggagttcaagaccagcctgaccaatatggtaaactccttctctactaa

SEQ ID NO: 705 - DNA, 401 bp, Homo sapiens
  misc_feature (1)...(401): n = A,T,C or G
ggagtgcagtggcatgatcacagctcactgcagcctcaacctcctgngctcaagtaatcctcccacctcagctttccaagtaactaggactacagatgcacaccaccatgcctggttaatttttgtaatttttgtagagatgaggttttgccatgttgcccaagttggtctcaaactcctgacctcaagtgatcctcccayctcagcctcccaaagtgctgggattacaggtgtgagccactgcactaggccttaaaatttatttttcaaaaacttgatgattcaaatcattgaagatgctcttatgccaaagaaaaggtagttctaggaagttcatggaatcttacaaacacctttacagctcaacagaattgcaaagatgggtagtgttttgttttgtt

SEQ ID NO: 706 - DNA, 401 bp, Homo sapiens
actcatatcaggtgaattagcaaacattctcatttcagacgatttttgctgtccctggtcatgaaatttccttaactgggttctatcttttactttttatcccaggcttttagcaagggtcataggaaaatggccatttccacatatctggtatatcccatttgaagatattgcctaacaaacattactcaggatcccttrcataaaaacctccatgataaatttcttctgtacttttttccccaaaaagctggattctcctgtaaaactgttatctattctctttatatattataattatggaattcattatcatttctactcttatctacatgactaggtcaccaacagctaattatatagctaattcatggtagttaattttatttacttctcttaag

SEQ ID NO: 707 - DNA, 401 bp, Homo sapiens
acagctaattatatagctaattcatggtagttaattttatttacttctcttaagtcatgacttacaaaattgcatttctatgtatgccatcttattacctccatttatttaagttgcatactacttcacatttcctttgaagtgtatattattattagtagtagtagtattttggagacagggtctcactctgttgcccakgctggagtgcagtggtgcaattatggctcactgcagcctcaaccttccaggctcaagctgttcacctacttcagcctccccagtagctgggactacaggtgtgtgccaccatgcttggctaattttttaaaaatttcctatttcttgtagagatagagtcttactatattgcctaggctggtcttgaactcctggacaca

SEQ ID NO: 708 - DNA, 401 bp, Homo sapiens
gattctcctgcctcagcctcctgagtagctgggactacaggcatgagccaacatgcccagctaattttcatatttttagtagagatagggtttcaccatgttggccaggttggcctcgatctcttgatctcgtgatccacccccccatcagcctcccaaagtgctgggattacaggtgtgagccattgcatccagcctcaraagaatagtataaaccttatgtgttcatataagcagtagaacctatccctaatagttggattttattgtgtaagtgtttcattaaggaatgtctgaaacatgtccagatttttatttcagtggcttagttttgccacagaacttcagttttataaatgtgtgtactggcttaactgtgaaagtattaaaattattgtatt

SEQ ID NO: 709 - DNA, 401 bp, Homo sapiens
tgttcccagagtcattactgaccaactgtgtgctttgatattatatttgctttctgatactaattatattaattctcgctcatagaaatcttccctccttcataccccacctctgtttgattcttaatctcatacataagaggtttttattcaatgtctcatttttctttccaggacaagtatgttgtaagaattaattartagtcttagaaccattcaagcagtaggttctaattgagtatttttctccccggttagcacagcaccctgtcagagccctcaaagtcagacaaagaaggatgaaacatgttttggtccttaataaagaactgctgattgactgtttgaaaaacaaatgccgcacacctgtaatcccagtgctttgggaggccaaggcagga

SEQ ID NO: 710 - DNA, 401 bp, Homo sapiens
ttctaggagtttggctcaattcagggctaacaaaaaaatctgtttagggccacttggggattagtgattctcaaaaggtagtccttgaatcacttactgaatacctatagttgaagaacagataactgcattttaacaagattcaaaggcaaattaatgtttgatgaccgttgacatcaagtctcagaatcagaactgttyaacttccaagcaaatgaaattactaaactcacttctctgagtgaggctgagagcaagaagttaagtataatgttttttgagctaaaatacagagtctactatcagaatcctgtttcccaccataaggattaagatttttttgtttttgtgtgtgtatgtgtgtgtgtgtgtgtgaatgtgtgtgtgtgtgtttgtttttt

SEQ ID NO: 711 - DNA, 401 bp, Homo sapiens
ctctactccctgctgcatacaacttccttctttctatctataaatactatatctgctctagaaacgtgaaaaataacataaatattgaacagagtgtgaaggaatttaaactttattgatgagtagtagtattacccttctggactgatgcagatgagagcaccataaagacaaagtgagttcttttggtccttaagccaygaattggagtctggatagtagggatggaaatgggttattagatcatcagttcactttcctctccaagcagcaattaaatttgttttctttgtctcagcttactcgttgctcaaaaaaaagaaacatttcagctcctcttcatggggaataagaccaaacatagaacacttttctcttaacatgtgtggtgcttgagagga

SEQ ID NO: 712 - DNA, 401 bp, Homo sapiens
tacagctgactccaagatgagtgtgatgctatcacggtgcaggataacagagatgtaccgcgaacccaacactcaagatgggaatgataaaacttcaataacaaaaacaaaaaaacaaaacaagccacactatcctttcagccttcagggatcgcctccttaaactgttttctaaaatctttctgcactttatatcaggtrcaggagaagtagactacatacattatttgttgtctatctttgaaaggatttcattccctctactgcacttaatcattcccttatctgaatattaactcagtgtaaagcttcccaaattttccaagttcttgaaagagagcaaaacatattgcaaagctctatatgtttcctgctagatatatttcgtgaaagacttcatt

SEQ ID NO: 713 - DNA, 401 bp, Homo sapiens
tgctctgaaactttgtgcatttgagggtttttttttccccgtgatttggtggactgcaagggcacacaaaactagcttatttttcctagtcaggcagttttgaatagaaggtgattgtgttttccagagataagtatgtaagtcttttctgctaccggaggaggattctattttagtagtctattaagtagacaataagcrctgagttatgagttgataagtggatctgcttaccacctagaaacatcaattgaaaccacagcttatggtttcttactgcctctttttggtttctcactgagtctttctggttattgttatcatttcgtttttgacttgggcttggactgttcagcttggctgtgttaatttttcagaatcaatgacttttatagttactt

SEQ ID NO: 714 - DNA, 401 bp, Homo sapiens
ttttcctcctgcattttatttaagcaattcactaactatttataagaccatctttgaaagcctgagatacatatctaggcaaatatccatggaaaaaataaacactctgcaaatttgcaaacaaatacagcaattgccaaagtagggttatcttttgcaatcagtactgtggtttcagtttgaaaaaataaagctttcttrtcagttttgctccaagggctatctgattcggtgtgtagtcggtgaggaaataaatacaggtataataatctgtgcttgctcaaaaattaaaaaatcctttaggagggggccaggcgtggtggctcatgcctgtaatcccagcaatttgggaagcagaggcagacagtttacctgaggtcaggagttcttgagaccagcct

SEQ ID NO: 715 - DNA, 401 bp, Homo sapiens
ggaggaaagatgagctttaaaaaaaaaaaagtgatactggagcaattggatatccaaaggcaaaaaaaaaaagtgcctaaattcatttctcacatcttatacagaaattaactcaaaattgattacagacttaaacataaaatgttaagcaataaaactttaggaaacaaacaggagaaaatgatgaggacctaaagctakgtgaagaacttctagacttgatactaaaagtatgattttcattttaaatgaattttaaaatgaatttcaatgaattttaaaattcattttaatcaactgggacctcatcaaaattaaaacttttgttctgtaagagaccctgtgtaaagaattaaaagaaamactacagagcaggagaaaacatttgccaaccacatatt

SEQ ID NO: 716 - DNA, 401 bp, Homo sapiens
ggaaacaaacaggagaaaatgatgaggacctaaagctakgtgaagaacttctagacttgatactaaaagtatgattttcattttaaatgaattttaaaatgaatttcaatgaattttaaaattcattttaatcaactgggacctcatcaaaattaaaacttttgttctgtaagagaccctgtgtaaagaattaaaagaaamactacagagcaggagaaaacatttgccaaccacatattcaagaaagattttgtacctagagagtataaagaactctcaaaactccacagtaaaatccaaacgatccaattaggaaaatgggcaagaaacataaacagaaattttaccaaagatgatatacagatggaaaataagcacatgaaaagatgttcaatatcatt

SEQ ID NO: 717 - DNA, 401 bp, Homo sapiens
ccaaccacatattcaagaaagattttgtacctagagagtataaagaactctcaaaactccacagtaaaatccaaacgatccaattaggaaaatgggcaagaaacataaacagaaattttaccaaagatgatatacagatggaaaataagcacatgaaaagatgttcaatatcattagccattaggaatatgcaaattaaamcaatgagatagcactatctacctatcaggatggctaaagtaaaaaagagtaataataccaattgctggagaggatgtggagaaactggatcactcatacattgttgatggaaatgtaaaatggtacactctgtaaacaatttgcttgcttcttataaaactaaacatgtatttaccatatgattcagcagttgtgctctt

SEQ ID NO: 718 - DNA, 401 bp, Homo sapiens
caagggaattgtgctaactaaaaataagccaatcacaaaagatttcatgtgatgtgattttatttatataatattcttgaaatgacaaaaatatagaaatggagaacagattagtagtttccaggggtcagagagtagaggagggagggaggtgtgtgtgtccataaaaacgttgcgccagggatcctggtgaggaagctrttctgtatcctcattgctggtgttcacgtgaatctacatatgtgataacatttgatggaaccaaatacacmcacaaacacacacatacacatatgagtgcatataagaccagagaaacttattttggtggattccgtaaatgtcaaatctttggttatgatattgaagtgtagtttggcaagatgttactattggggaaa

SEQ ID NO: 719 - DNA, 401 bp, Homo sapiens
tattcttgaaatgacaaaaatatagaaatggagaacagattagtagtttccaggggtcagagagtagaggagggagggaggtgtgtgtgtccataaaaacgttgcgccagggatcctggtgaggaagctrttctgtatcctcattgctggtgttcacgtgaatctacatatgtgataacatttgatggaaccaaatacacmcacaaacacacacatacacatatgagtgcatataagaccagagaaacttattttggtggattccgtaaatgtcaaatctttggttatgatattgaagtgtagtttggcaagatgttactattggggaaaatagtaacattgtactattgtcctgtgaattattgattcacaggaaattgtaaaaaaaaatgctttgtcct

SEQ ID NO: 720 - DNA, 401 bp, Homo sapiens
aatctttggttatgatattgaagtgtagtttggcaagatgttactattggggaaaatagtaacattgtactattgtcctgtgaattattgattcacaggaaattgtaaaaaaaaatgctttgtcctatacatttttttagaatttcctgtcaatccataattatttcaagataaaaaaagttttgtaaaggaagaattttkgagactctttcagattttttattttgagatttaatcwattatatgagaaaaataagctttaactgaccactctttccttcctatccaaagcttagtcaatgagaaaatgttgcaagagaaggagaatggggggtacctgagactccaggagagtacataccctttttaaaaaagcaatacaagccagcagaaaaaggaar

SEQ ID NO: 721 - DNA, 401 bp, Homo sapiens
atgttactattggggaaaatagtaacattgtactattgtcctgtgaattattgattcacaggaaattgtaaaaaaaaatgctttgtcctatacatttttttagaatttcctgtcaatccataattatttcaagataaaaaaagttttgtaaaggaagaattttkgagactctttcagattttttattttgagatttaatcwattatatgagaaaaataagctttaactgaccactctttccttcctatccaaagcttagtcaatgagaaaatgttgcaagagaaggagaatggggggtacctgagactccaggagagtacataccctttttaaaaaagcaatacaagccagcagaaaaaggaargatgggactctggagcgattatgtgaatctgtggttc

SEQ ID NO: 722 - DNA, 401 bp, Homo sapiens
kgagactctttcagattttttattttgagatttaatcwattatatgagaaaaataagctttaactgaccactctttccttcctatccaaagcttagtcaatgagaaaatgttgcaagagaaggagaatggggggtacctgagactccaggagagtacataccctttttaaaaaagcaatacaagccagcagaaaaaggaargatgggactctggagcgattatgtgaatctgtggttctcaaagttcagcatgcatcagattcccagagggcttgtttaaacaaaaatttctgccctgcaaccacagagtttctgattcactaggtctgggggtggtgggtgtggttcaagaatctgcatttctagaaagttcccatgtgatgttgactccagtgctgatg

SEQ ID NO: 723 - DNA, 401 bp, Homo sapiens
tggagcgattatgtgaatctgtggttctcaaagttcagcatgcatcagattcccagagggcttgtttaaacaaaaatttctgccctgcaaccacagagtttctgattcactaggtctgggggtggtgggtgtggttcaagaatctgcatttctagaaagttcccatgtgatgttgactccagtgctgatgctgctggtcaraccacactctggaaactactgccatagaacatctgagagtcacaatttgaaactgtctcaagaaatttctaagtaaaatgcaatgcaataaattacttaagaattctctatatttacaactctttatttgwatagtttccttccccctcagtatgttggctggtaagaatgttctttttgattattcatctgtgtgggct

SEQ ID NO: 724 - DNA, 401 bp, Homo sapiens
tggttcaagaatctgcatttctagaaagttcccatgtgatgttgactccagtgctgatgctgctggtcaraccacactctggaaactactgccatagaacatctgagagtcacaatttgaaactgtctcaagaaatttctaagtaaaatgcaatgcaataaattacttaagaattctctatatttacaactctttatttgwatagtttccttccccctcagtatgttggctggtaagaatgttctttttgattattcatctgtgtgggctcaagagtgtgtcactgagttaatttacaaagcctcggattgcatatccatcacatttgtagaaagtattatcccagaaaaatccatcaacacaacacataagctccaaaatgtactgcacaattggcgtgc

SEQ ID NO: 725 - DNA, 401 bp, Homo sapiens
tggtaagaatgttctttttgattattcatctgtgtgggctcaagagtgtgtcactgagttaatttacaaagcctcggattgcatatccatcacatttgtagaaagtattatcccagaaaaatccatcaacacaacacataagctccaaaatgtactgcacaattggcgtgcaatagagtagtcaaagaaccaatgaaatgyaaaaagttatctatatggagatctcaaaatgaattaacaaattaaatcctttgacattgtatgagatcccattagggttcattgttacagttttctttaatgtttctaaaatagaaatgttgtcctgggcagagcagtgtaatgtacttgctttggcatcaaatgccacattttttttttttttgagacggcgtcttgct

SEQ ID NO: 726 - DNA, 401 bp, Homo sapiens
ttctttaatgtttctaaaatagaaatgttgtcctgggcagagcagtgtaatgtacttgctttggcatcaaatgccacattttttttttttttgagacggcgtcttgctctgtcacctaggctggagtgagtgtgcagtggtgcaatcgtagctcactgtagcctcgaactcctgggcttaagcaatcctcccacctcagcmtcctgagtagctgggactacaggtcccagstgcccagctatttttaaaattttttgtagagacaagtcttgctatgttgcccwggctgatcttaaactcctagcctcaagaaatccttcagacttgtcctcctagagtgttgggattacaggtgtgagcctccacaccaggcattgtttctattttaactttgctactta

SEQ ID NO: 727 - DNA, 401 bp, Homo sapiens
tcctgggcagagcagtgtaatgtacttgctttggcatcaaatgccacattttttttttttttgagacggcgtcttgctctgtcacctaggctggagtgagtgtgcagtggtgcaatcgtagctcactgtagcctcgaactcctgggcttaagcaatcctcccacctcagcmtcctgagtagctgggactacaggtcccagstgcccagctatttttaaaattttttgtagagacaagtcttgctatgttgcccwggctgatcttaaactcctagcctcaagaaatccttcagacttgtcctcctagagtgttgggattacaggtgtgagcctccacaccaggcattgtttctattttaactttgctacttacgagaagtcttaatttgaccaacaactaat

SEQ ID NO: 728 - DNA, 401 bp, Homo sapiens
tttttttttgagacggcgtcttgctctgtcacctaggctggagtgagtgtgcagtggtgcaatcgtagctcactgtagcctcgaactcctgggcttaagcaatcctcccacctcagcmtcctgagtagctgggactacaggtcccagstgcccagctatttttaaaattttttgtagagacaagtcttgctatgttgcccwggctgatcttaaactcctagcctcaagaaatccttcagacttgtcctcctagagtgttgggattacaggtgtgagcctccacaccaggcattgtttctattttaactttgctacttacgagaagtcttaatttgaccaacaactaatgtaagctctagtttccccatatgtaaaaagaagataatgcctaaattgcaggg

SEQ ID NO: 729 - DNA, 401 bp, Homo sapiens
gggtttattgggagaattaataagaacacgcctaggccaggcacaatggctcatgcctgtaatcccagcactttgggaggccaaggcagctggatcatgaggtcaggagttcgagaccaccctgaccaacgtggtgaaaccctgtctctactaaaaatacaaaaattaggggagtgtggtggtgggcgcctataatcccasctactcaggaggcttaggcaggagaatcacttgaacccgggaggcggaggttgcagtgagccgagatcgtgcaattgcactccagacttggcaacagagcaagactccatctcaaaaagaaaaaagaaaaagaaaaataagaacacgtctaaaataattagtgcagtgtctgacacttaagttctcaaatagtggcggtg

SEQ ID NO: 730 - DNA, 401 bp, Homo sapiens
aaaacttaaagagtttaatatattgctcaaggttatccagtgtattggtttgctagggctctgtaacaaagtaccacaaaccaggtggctcaaacaacagaaatgcattgtttcacagttctggcgtcaaaaagtccaaaatcacagtgttggcagctttggttccttctgagggctgcaagggaaagattgttctgggtmcttctccttggcttgtagatgtctgtcttctccctgtgtctctccatgtcattttttcctctatgcatgtctgtctctgtgtccaaatttttccattttaaaaggacattagtcattgctgggcacaatggctcacacctgcaatcccagcactttgggaggctgagagaggcagatcacttgaggccaggagttcgaga

SEQ ID NO: 731 - DNA, 401 bp, Homo sapiens
cttctccttggcttgtagatgtctgtcttctccctgtgtctctccatgtcattttttcctctatgcatgtctgtctctgtgtccaaatttttccattttaaaaggacattagtcattgctgggcacaatggctcacacctgcaatcccagcactttgggaggctgagagaggcagatcacttgaggccaggagttcgagaygagcctggccaacatggtgaaacgtgtctctgcaaaataatacaaaaattagctaggtatggtggtgcatgcctatagttccagctatttctactcaggaggctgaggcatgagaattgcttgaacccaggaggcagacgttgcagtgagctgagatcatgccactgcactccaacctgggtgacagagtaagactctgt

SEQ ID NO: 732 - DNA, 401 bp, Homo sapiens
aaaaattagctaggtatggtggtgcatgcctatagttccagctatttctactcaggaggctgaggcatgagaattgcttgaacccaggaggcagacgttgcagtgagctgagatcatgccactgcactccaacctgggtgacagagtaagactctgtctcaaaagaaaaaaaaaaaaaaagggcattagtcattggattasggcccaccctatggaactcattttaacttgatgagctctgtaaagaccctatctctaaattatatcacattctgaggtgctgggaggtaacactccaacttatctttattgaggggggcagaattcaaatccatagcacatagtagtaagatgtcatgctgaggtatgaaccagacttcatacgcaatgctgtggactaa

SEQ ID NO: 733 - DNA, 401 bp, Homo sapiens
ttgtgttggaattagcacccttataagaagaaaaaaaggccaaagcctcctctctctctgccacctgaaaatgcaacagggaatggccatccacatgccaagaaatgggcccttatcatacaccaagtcttcctgcacattgatcctcgatttctcaggttttggaactgcaggaaatcgacgttcattgtttaagccacrcagtctatggtattttgttatagctgcctgagctgactaagacaggcaatatatgacatggccgtttgctccaggacttttaggaaatgtggatcccattggtagtgctcagcaatcaaatttatttgatcctcatgttcagcagacatgttgtttttttcttcatgtattgccaactcttttatatgatacataaaaca

SEQ ID NO: 734 - DNA, 401 bp, Homo sapiens
acctaaaccagctgttgagaagtagtggcaaaggccagttgtttcaaagtcatagagatcaggctccttaaaagagaagtatttaaaatgaaaaacattaatatcaaagattatgttaaagaccagagtttaaccctgagcataccagtccagcaaattccaaaaggtgggtggggaaaatctttcagttacacagtaccrttcgttgagtttcttgaagctaggatgtcaatgttcttgatgatgttcagtctcggttagctttcctctaagagaatgaaggacctgagcttttcaccagaatttgttaggggctcagacagtggtttgtgcagggaaaagtctggcctgcgtgtaatctgctgcagtggtgagttcttcaaagtttgaatcaagtagtt

SEQ ID NO: 735 - DNA, 401 bp, Homo sapiens
aatctgggcaatcagatgttatttttcagtgacatcaagttagggaaagagagaaaaattggaaacattaatttgtagggttgtagccagatattgaagcaaactggaaggcttcacagtttggtacaaattaacaatttgggcaagataacaggatccagttcaatttttaggaaggtgtccaaactgctttttccacaraggaggggaagtcatttaaatcattccagacaagtcagaatttgcatatgtatcagttacctgcaatttatgaaactgtataatatggctaagagataattatgtctacaatctgataaacaggaaggagctgcttgctatagttttccactgaaacaaaacatttctctctatagtcacccctcttttgatcaaaaata

SEQ ID NO: 736 - DNA, 401 bp, Homo sapiens
gaaactgtataatatggctaagagataattatgtctacaatctgataaacaggaaggagctgcttgctatagttttccactgaaacaaaacatttctctctatagtcacccctcttttgatcaaaaataatctcaaagaaagattattcttgatcacaaaataaagctagtaccatcagatttggcctgattatttacatkgttgtcttaaagatgataattcactacatagggtttcttatatttgctttgctgaaagttttcataaggaatctcaaattgaatttttaaaaaccacttgaggctaggaagctatatcaagaactcaccaacagatttacctacagtatctataaatttcrgtaaatgcctctcttttagaggtcccaaaaatatctcaa

SEQ ID NO: 737 - DNA, 401 bp, Homo sapiens
taaagctagtaccatcagatttggcctgattatttacatkgttgtcttaaagatgataattcactacatagggtttcttatatttgctttgctgaaagttttcataaggaatctcaaattgaatttttaaaaaccacttgaggctaggaagctatatcaagaactcaccaacagatttacctacagtatctataaatttcrgtaaatgcctctcttttagaggtcccaaaaatatctcaagttttctgagcctgcgaggaagtatcctttacctgtaaatttgggcacctcattagccagraatcaggctgrttttcccaagagggctttaaatgagcatacctaatgtttccaatatttcatgcaaacaaggaagagttttattgaacctatgcaaataa

SEQ ID NO: 738 - DNA, 401 bp, Homo sapiens
ttcataaggaatctcaaattgaatttttaaaaaccacttgaggctaggaagctatatcaagaactcaccaacagatttacctacagtatctataaatttcrgtaaatgcctctcttttagaggtcccaaaaatatctcaagttttctgagcctgcgaggaagtatcctttacctgtaaatttgggcacctcattagccagraatcaggctgrttttcccaagagggctttaaatgagcatacctaatgtttccaatatttcatgcaaacaaggaagagttttattgaacctatgcaaataactataattttgaaatataatgagaatactcagtaagaatttctgatttctctaacagtcaggcaggaagaaaaagataccaatgacaaatgtttcattta

SEQ ID NO: 739 - DNA, 401 bp, Homo sapiens
tctcaaattgaatttttaaaaaccacttgaggctaggaagctatatcaagaactcaccaacagatttacctacagtatctataaatttcrgtaaatgcctctcttttagaggtcccaaaaatatctcaagttttctgagcctgcgaggaagtatcctttacctgtaaatttgggcacctcattagccagraatcaggctgrttttcccaagagggctttaaatgagcatacctaatgtttccaatatttcatgcaaacaaggaagagttttattgaacctatgcaaataactataattttgaaatataatgagaatactcagtaagaatttctgatttctctaacagtcaggcaggaagaaaaagataccaatgacaaatgtttcatttatatttgcaaag

SEQ ID NO: 740 - DNA, 401 bp, Homo sapiens
ttaaatgagcatacctaatgtttccaatatttcatgcaaacaaggaagagttttattgaacctatgcaaataactataattttgaaatataatgagaatactcagtaagaatttctgatttctctaacagtcaggcaggaagaaaaagataccaatgacaaatgtttcatttatatttgcaaagcatagacttctgaattrttatgagtttcagttagtttaagagaaaatagaaakaagtttcctatgtccaaaaaatcaaccattaaaatatcagcaatattccaaacaaaagctacagtcattcctcatcagttccttcagtcctgtgtaattcttgctctgcttcctcttggcttaacagtttcatgcatacatctgcctctccaaacagggctctg

SEQ ID NO: 741 - DNA, 401 bp, Homo sapiens
caaacaaggaagagttttattgaacctatgcaaataactataattttgaaatataatgagaatactcagtaagaatttctgatttctctaacagtcaggcaggaagaaaaagataccaatgacaaatgtttcatttatatttgcaaagcatagacttctgaattrttatgagtttcagttagtttaagagaaaatagaaakaagtttcctatgtccaaaaaatcaaccattaaaatatcagcaatattccaaacaaaagctacagtcattcctcatcagttccttcagtcctgtgtaattcttgctctgcttcctcttggcttaacagtttcatgcatacatctgcctctccaaacagggctctggaaatcctgactcagtctgctggtatggtctcaagg

SEQ ID NO: 742 - DNA, 401 bp, Homo sapiens
gtgtaattcttgctctgcttcctcttggcttaacagtttcatgcatacatctgcctctccaaacagggctctggaaatcctgactcagtctgctggtatggtctcaaggttgtgtaagtgacggcatcagaagcttctgccccaaatgaaaagtacctggcatagagctttgccatggggctctgagataatcctttgttragacaaagcactacagctagatttgtaagagctttcagggaagcaccacaaagcaaaattctatttgtaaatgacaaaagccttaaaaattactttgaaaaatcattttcaaacgtgaaagatgtaaggagtgtttatcacaagaatctccatttgaaaaatactggcttataggcacagaaaaacaaagatagtatgtt

SEQ ID NO: 743 - DNA, 401 bp, Homo sapiens
aaattgggaagagtaaatttcaaatgttctcacacaacaaaatgactagtatttgaagtgatgtcgttaactggctcaatttaattattccacatggtaggcataaatcatattatcactttgtaccccatatacttacaatatcataaattgtcaatttacagtttttttttaaaaaaaaggaaagcactggcttagaakaagctaatttgaaattaacgaataaaagttgttaccaagttaacattttaaaaataactgaaacttatgactcatgtggtgctctctaataacagggcaaagtgacatcgggactcaaagaaaaacacgttatggacataaaagcctttgatgactctctaggaattttccatacagcatacaatttctgaaatatttat

SEQ ID NO: 744 - DNA, 401 bp, Homo sapiens
aaacttatgactcatgtggtgctctctaataacagggcaaagtgacatcgggactcaaagaaaaacacgttatggacataaaagcctttgatgactctctaggaattttccatacagcatacaatttctgaaatatttatactgataacattctgcccatacagatttgtcctagggaaggttaagcatctcttctgagtwggcaatgactcccgtgcaatttgtaaatagtaacatatcaaataaacctaattcttttcagcaactttcttttcataaggtgaaataacaaatcctttgtgattttcaaaggccctctgggagatatcaaagacagtttcagatgcaatagatatcacttaggaatcagttttgggagggaaaatatcaaaagttgtcag

SEQ ID NO: 745 - DNA, 401 bp, Homo sapiens
actaggatacggtcgtgagttactgataaacaatactttgctaccttaactaaggtgacagcaaaaagagtgaaaaagtaagcacaggcagtaacatgattgtaaagaatcttagctttttcaaaagggagaagactttattaaataagcaaggacgtgataaactcaatacacaatataggaagttattttaagacatgkaatctttgccttctaggcagattactcagaaggtaaagaaaaaatattattaagagtagactaagaagtyaagaaaatgttatgtttttaaacagaggcaaaattaaattctactttgcatcattatggcatttgatattaaagatctttttgaaatcttataaatgaattcatcaagccttagctagcactgaccacag

SEQ ID NO: 746 - DNA, 401 bp, Homo sapiens
tgaaaaagtaagcacaggcagtaacatgattgtaaagaatcttagctttttcaaaagggagaagactttattaaataagcaaggacgtgataaactcaatacacaatataggaagttattttaagacatgkaatctttgccttctaggcagattactcagaaggtaaagaaaaaatattattaagagtagactaagaagtyaagaaaatgttatgtttttaaacagaggcaaaattaaattctactttgcatcattatggcatttgatattaaagatctttttgaaatcttataaatgaattcatcaagccttagctagcactgaccacagcaaagtttgtttcccacaagcgttttacaactttctacgtctattcagcttttgtcctacacattaacaa

SEQ ID NO: 747 - DNA, 401 bp, Homo sapiens
aggaagaacattcacaagtagaatagaagcatacttgtgttatatttaacactaaaaactcagagaaaacagctatttttactaaatcaacctcattaattgattatcaaaataataattattgttaaatattgtttgccaaacatttacctagattttgtgaacttgaattattgtctctgagttatgttcctacaagakacagctttttcccctacagtaaaagtgtttaaggctcaatttcctcaacttctgggaatttgggaaatatttggtttatataaatggttatttatttctaagccaattagaatagagctcctttaagagattctataacctaatttagcgacaccatcctgaggtagggaaatattttatttttatttttttcagagatg

SEQ ID NO: 748 - DNA, 401 bp, Homo sapiens
ggtttatataaatggttatttatttctaagccaattagaatagagctcctttaagagattctataacctaatttagcgacaccatcctgaggtagggaaatattttatttttatttttttcagagatgggctagattagaactcctgccttcagcctcctgagtagctaaggttgcaacttccatagtagctgaaattgtrggtgcatgccaccrtatctggccaacagggaaatattacatactctaacaatgagtggtgacwtcctttctgaattacagacatgtagacattaaagcagagatagcaagaatttagtttccattctaacatttaagccatgggtcaagagtggacacagaatcacaaaacttactgtttcatatcaaagagctgttctg

SEQ ID NO: 749 - DNA, 401 bp, Homo sapiens
gttatttatttctaagccaattagaatagagctcctttaagagattctataacctaatttagcgacaccatcctgaggtagggaaatattttatttttatttttttcagagatgggctagattagaactcctgccttcagcctcctgagtagctaaggttgcaacttccatagtagctgaaattgtrggtgcatgccaccrtatctggccaacagggaaatattacatactctaacaatgagtggtgacwtcctttctgaattacagacatgtagacattaaagcagagatagcaagaatttagtttccattctaacatttaagccatgggtcaagagtggacacagaatcacaaaacttactgtttcatatcaaagagctgttctgttctcatgattctt

SEQ ID NO: 750 - DNA, 401 bp, Homo sapiens
taacctaatttagcgacaccatcctgaggtagggaaatattttatttttatttttttcagagatgggctagattagaactcctgccttcagcctcctgagtagctaaggttgcaacttccatagtagctgaaattgtrggtgcatgccaccrtatctggccaacagggaaatattacatactctaacaatgagtggtgacwtcctttctgaattacagacatgtagacattaaagcagagatagcaagaatttagtttccattctaacatttaagccatgggtcaagagtggacacagaatcacaaaacttactgtttcatatcaaagagctgttctgttctcatgattcttaagtgatttgagctcaaaacagacaaacagaaaagcgtagcaaaccaaa

SEQ ID NO: 751 - DNA, 401 bp, Homo sapiens
agggcccaaataagccttattacctgtgttgagtaaacaaagatcccagtgcaggagatccatatcatggcaccaaactatcaaatacaggatgcactaggtcattaaagagaagattttattcaaagcattgcaaaatggagaacattgatttatggtgaatatcttgaagaaaaggaagggggtctggggttctatagrggcaagaaaaaacgggagtcatccagaagtcttataaaagtcatgaagaagggtggagatgggtcttatctcagaatatgggaaggcagtttgggcctttgcattagttgtttgccagacactaaagggtagagaggtttcttaatcattactcttttccrgaagcacagggctcaggtaagattgaatatttttcatgc

SEQ ID NO: 752 - DNA, 401 bp, Homo sapiens
atatcttgaagaaaaggaagggggtctggggttctatagrggcaagaaaaaacgggagtcatccagaagtcttataaaagtcatgaagaagggtggagatgggtcttatctcagaatatgggaaggcagtttgggcctttgcattagttgtttgccagacactaaagggtagagaggtttcttaatcattactcttttccrgaagcacagggctcaggtaagattgaatatttttcatgcctttcatcctctctgtctgatctctttcaaacygtcttttttgttgaggctatatgaaatgtttactgttttaccttccaatcaactccataaaaacggttgatataaagcatctagccaagttccactacattttagtcattcattatggaacatcatcc

SEQ ID NO: 753 - DNA, 401 bp, Homo sapiens
tataaaagtcatgaagaagggtggagatgggtcttatctcagaatatgggaaggcagtttgggcctttgcattagttgtttgccagacactaaagggtagagaggtttcttaatcattactcttttccrgaagcacagggctcaggtaagattgaatatttttcatgcctttcatcctctctgtctgatctctttcaaacygtcttttttgttgaggctatatgaaatgtttactgttttaccttccaatcaactccataaaaacggttgatataaagcatctagccaagttccactacattttagtcattcattatggaacatcatcccaaggaaggctttattctctctgtctaagcaagcaatgaagggagatcttttggaaatggcctagtatttga

SEQ ID NO: 754 - DNA, 401 bp, Homo sapiens
aaaacttcacagtgtatgatgacactgataccttctagtctattcccagctgttctatttcatttttttatagcttatagtgactcattaaaatggatttccacgaatgcaatgcaacacacagtttgaagtccactggaaaatcttttaaaactgttattataaaatgaatttagtaaccttttcaaaattttactagtrtagtttctgtggtttttaagaatacaaatattttgccttctggtcttttttttcacacaagtatatggcagattcctataaatattttaatagatcagcagtttccaatgccatgtttcggtgatgatattttaccagagatagtctgtaatgaaaaattgagacaaatgatgacaatgtaatttgcagacatgtatact

SEQ ID NO: 755 - DNA, 401 bp, Homo sapiens
ttaatagatcagcagtttccaatgccatgtttcggtgatgatattttaccagagatagtctgtaatgaaaaattgagacaaatgatgacaatgtaatttgcagacatgtatacttatttataataaatttgtagacatgtatatttagttagttattcaacaaatattcagtgccttttatatcttaagaatggttcatgwtaattggaggcaaacaagaaaggcaaagttactgcttagttgaaatttacattctagtataaaaattgccatatttattattattattattattatacttaaagttctgggatacatgtgcagaatgtgcaggtttgttacataggcatacgcttgccatggtggtttgttgcacccatcaacccatcatctacattagg

SEQ ID NO: 756 - DNA, 401 bp, Homo sapiens
tgggatacatgtgcagaatgtgcaggtttgttacataggcatacgcttgccatggtggtttgttgcacccatcaacccatcatctacattaggtatttctcctaatgctatccctccccgctccccccaccccacaacaggccctggtgtgtgatgttcccctccctgtgtccatgtgttctcactgttcaactcccactwatgagtaagaatatgcagtgtttgtttttctgttcctgtgttagtttgctgagaataatagctttcagcttcatccatgtccctgcaaaggacacaaactcaaccttttttatggttgcrtagtattttgtggtgtatatgtggcacattttctttatccattctatcattgatgggcatttgggttggatccaagtctt

SEQ ID NO: 757 - DNA, 401 bp, Homo sapiens
ctccccccaccccacaacaggccctggtgtgtgatgttcccctccctgtgtccatgtgttctcactgttcaactcccactwatgagtaagaatatgcagtgtttgtttttctgttcctgtgttagtttgctgagaataatagctttcagcttcatccatgtccctgcaaaggacacaaactcaaccttttttatggttgcrtagtattttgtggtgtatatgtggcacattttctttatccattctatcattgatgggcatttgggttggatccaagtctttgctattgtgaatagtgctacaataaacatatgtgtgcatgtgtctttataatagagtgacttataatcctttgggtgtatacccagtaatgggattgctgggtcaaatggtatttctgg

SEQ ID NO: 758 - DNA, 401 bp, Homo sapiens
gcccatgcctatgtcctgaatgatactgcgtcagttttcttccagagttttatggttttaggtcttatgtgtaagtctttaatccatcttgagttaatttttgtataaggtgtaaggaagaggtccagtttcagttttttgcatatggctagccagttttcccaacaccatttattaaatagggaatcttttccccattgyttgtttttgtcaggtttgtaaaaaatcagatagttgtagatgtgtggcattatttctgaggcctctgttctgttccattggtctatatatctgttttggtaccagtaccatgctgtttgggttactgtagccttgtagtatagtttgaagtcaggtagcttgttgcctccagctttgttctttttgcctaggattgtctt

SEQ ID NO: 759 - DNA, 401 bp, Homo sapiens
ttgtagatgtgtggcattatttctgaggcctctgttctgttccattggtctatatatctgttttggtaccagtaccatgctgtttgggttactgtagccttgtagtatagtttgaagtcaggtagcttgttgcctccagctttgttctttttgcctaggattgtcttggctatacaggctctcttttggttccatatgaamtttaaagtagttttatctaattctgtgaagaaagtcaatrgtagcttgatggggatagcattgaatctataaattactttgggcagtatggccattttcatgatattgattcttcctatccatgagcatggaatgtttttccatttgtttgtatcctctcttatttccttgagcagtggtttgtagttctccttgaagac

SEQ ID NO: 760 - DNA, 401 bp, Homo sapiens
tccattggtctatatatctgttttggtaccagtaccatgctgtttgggttactgtagccttgtagtatagtttgaagtcaggtagcttgttgcctccagctttgttctttttgcctaggattgtcttggctatacaggctctcttttggttccatatgaamtttaaagtagttttatctaattctgtgaagaaagtcaatrgtagcttgatggggatagcattgaatctataaattactttgggcagtatggccattttcatgatattgattcttcctatccatgagcatggaatgtttttccatttgtttgtatcctctcttatttccttgagcagtggtttgtagttctccttgaagacgtccttcacatcccttgtaagttgtattcctagggatttt

SEQ ID NO: 761 - DNA, 401 bp, Homo sapiens
tccatttgtttgtatcctctcttatttccttgagcagtggtttgtagttctccttgaagacgtccttcacatcccttgtaagttgtattcctagggattttattctctttgtagccattgtgaatgggagttcactcatgatttggctctctgtttttctattattgatgtataggaatgcttgtggtttttaaacattgwttttgtattctgaaactttgctgaaattgcttatcaktttaaggagattttgggctgagaagatggggttttctaaatgtacaatcatgtcatctacaaacagagacaatttgacttcctcttttccaatttgaatatactttatttctttctcttgcctgattgccctggccagaacttccaatacaatgttgaatagg

SEQ ID NO: 762 - DNA, 401 bp, Homo sapiens
tggtttgtagttctccttgaagacgtccttcacatcccttgtaagttgtattcctagggattttattctctttgtagccattgtgaatgggagttcactcatgatttggctctctgtttttctattattgatgtataggaatgcttgtggtttttaaacattgwttttgtattctgaaactttgctgaaattgcttatcaktttaaggagattttgggctgagaagatggggttttctaaatgtacaatcatgtcatctacaaacagagacaatttgacttcctcttttccaatttgaatatactttatttctttctcttgcctgattgccctggccagaacttccaatacaatgttgaataggagtggtgacagagggcatccttgtcttgtgccagttt

SEQ ID NO: 763 - DNA, 401 bp, Homo sapiens
tgattgccctggccagaacttccaatacaatgttgaataggagtggtgacagagggcatccttgtcttgtgccagttttcaaatgcttcctgtttttgcctattcagtatgatattgcctggggggttgccataaatgactcttattatttttggatacattccatcaataggtagtttattgagagcttttagcatgaartagcattgaattttatggaaggccttttctgcatctattgagacaatcatgttgtttttgtcattggttctgcttatgtgatggattacgtttattggtttgtgtatgttgaaccagccttgcatcccagggatgaggctgacttgatcgtggtggataagctttttgatgtgctgctggattcagtttgccagtatttt

SEQ ID NO: 764 - DNA, 401 bp, Homo sapiens
tgttttgcctctgccaggttttgctatcaggatgatgctggcatcataaaatgagttagggagaagtacctctttttctgtcatttggaatggtttcagaaggaatggtaccagctcctctttgtacctctggtagaaatcggctgtgaatctgtctggtcttgggcttttcgattggtaggctattaattactgcctcartttcagaacttgttattggtctattcagggatttsacttcttcctggtttagtcttgggagggtgtatgtgtctaggagtttatcaatttcttctagattttctagtttatttgcgtagaggtgtttatagtattctctgatggtagtttgtatttctgtgggatcagtggtgatatccccttcatcatttttttattgt

SEQ ID NO: 765 - DNA, 401 bp, Homo sapiens
tgctggcatcataaaatgagttagggagaagtacctctttttctgtcatttggaatggtttcagaaggaatggtaccagctcctctttgtacctctggtagaaatcggctgtgaatctgtctggtcttgggcttttcgattggtaggctattaattactgcctcartttcagaacttgttattggtctattcagggatttsacttcttcctggtttagtcttgggagggtgtatgtgtctaggagtttatcaatttcttctagattttctagtttatttgcgtagaggtgtttatagtattctctgatggtagtttgtatttctgtgggatcagtggtgatatccccttcatcatttttttattgtgtctatttgattcttctctcttttcttctttatta

SEQ ID NO: 766 - DNA, 401 bp, Homo sapiens
tgttctcattggtttcaaagaacttatttatttctgccttcatttcattatttacccagtagtcattcaggagcaggttgttcaggttccatgtagttgtgtggctttgagtgagtttcttcatcctgagttctaatttgattgcactgtggtcaaagagactgttatgatttccattcctttgtgtttgctgaggagtgyttcacttccaattatgtggtcagttttagaataagtgagatgtggtgctgagaagaatgtawattctgttgatttggggtgtagagttctgtagatgtccattaagtctgcttagtccagagctgagttcaatggaatatccttgttaattttctgtcttgttgatctgyctaatgttgacagtcaggtattaaagtccc

SEQ ID NO: 767 - DNA, 401 bp, Homo sapiens
tcattcaggagcaggttgttcaggttccatgtagttgtgtggctttgagtgagtttcttcatcctgagttctaatttgattgcactgtggtcaaagagactgttatgatttccattcctttgtgtttgctgaggagtgyttcacttccaattatgtggtcagttttagaataagtgagatgtggtgctgagaagaatgtawattctgttgatttggggtgtagagttctgtagatgtccattaagtctgcttagtccagagctgagttcaatggaatatccttgttaattttctgtcttgttgatctgyctaatgttgacagtcaggtattaaagtccccactattattgtgtgggagtctaagtctctttgtaggtctctaagaacttgctttatgaatc

SEQ ID NO: 768 - DNA, 401 bp, Homo sapiens
tttccattcctttgtgtttgctgaggagtgyttcacttccaattatgtggtcagttttagaataagtgagatgtggtgctgagaagaatgtawattctgttgatttggggtgtagagttctgtagatgtccattaagtctgcttagtccagagctgagttcaatggaatatccttgttaattttctgtcttgttgatctgyctaatgttgacagtcaggtattaaagtccccactattattgtgtgggagtctaagtctctttgtaggtctctaagaacttgctttatgaatctgggtgctcctcatattgggaatctggttgctccttgtatttggatgygtatatatttaggatagttaactcttcttgttgcattgatctctttaccattacataatg

SEQ ID NO: 769 - DNA, 401 bp, Homo sapiens
gcttagtccagagctgagttcaatggaatatccttgttaattttctgtcttgttgatctgyctaatgttgacagtcaggtattaaagtccccactattattgtgtgggagtctaagtctctttgtaggtctctaagaacttgctttatgaatctgggtgctcctcatattgggaatctggttgctccttgtatttggatgygtatatatttaggatagttaactcttcttgttgcattgatctctttaccattacataatgcccttctttgtctttatctttattgatttgaagtctgttttatcagagactaggattgcaacctctgctttttcttgctttccatatcttggtaaatattcctccatccctttattttgagcctgtgtgtgtctttgcac

SEQ ID NO: 770 - DNA, 401 bp, Homo sapiens
tgtctcctgaatacagcacaccaatgggtcttgactctttctccaatctgccagtctgtgtctttaattggggcatttagcccatttacatttaaggttaatattgttatatgtgaatttgatcctgtcattatgatgctagctggttattttgcctgttagttgatgcagtttcttcatagtgtcaatggtccttacaawttggtatgtttttgtggtggctgttaccaktttttcctttccatatttagtgcttccttcaggagctcttgtaaggcagacctggtggtggcaaaacctctcagcatttgtttgtctgtaaaggattctatttctccttcacttatgaagcttagtttggctggatatgtaattctgggttgaaaattcttttctttaag

SEQ ID NO: 771 - DNA, 401 bp, Homo sapiens
ttgactctttctccaatctgccagtctgtgtctttaattggggcatttagcccatttacatttaaggttaatattgttatatgtgaatttgatcctgtcattatgatgctagctggttattttgcctgttagttgatgcagtttcttcatagtgtcaatggtccttacaawttggtatgtttttgtggtggctgttaccaktttttcctttccatatttagtgcttccttcaggagctcttgtaaggcagacctggtggtggcaaaacctctcagcatttgtttgtctgtaaaggattctatttctccttcacttatgaagcttagtttggctggatatgtaattctgggttgaaaattcttttctttaagagtgttgaatattggcccccaatctcttct

SEQ ID NO: 772 - DNA, 401 bp, Homo sapiens
gtcgatacttgtgtatgcttcgcaaagttctcatgcagtgtttttcagctccatcaggtctttatgttcttctgtaaagtggttattctagtaagcaattcctctaaccttttttcaagtttcttaccttccttgcattgggaggagcttgttattacccaccttctgaagcctaattctgtcaattcatcaaactcattmtccatccagttttgttcccttgctggtgaggagtttgtgatcctttggagragaagaggtgttctggtttttggaattttcaggctttttgcactgatttatcctcatctgtgtggatttatctacctttggtctttgatactggtgacctttggatggggtttttgtgtggatgtcctttttgttgatattgatgctat

SEQ ID NO: 773 - DNA, 401 bp, Homo sapiens
catcaggtctttatgttcttctgtaaagtggttattctagtaagcaattcctctaaccttttttcaagtttcttaccttccttgcattgggaggagcttgttattacccaccttctgaagcctaattctgtcaattcatcaaactcattmtccatccagttttgttcccttgctggtgaggagtttgtgatcctttggagragaagaggtgttctggtttttggaattttcaggctttttgcactgatttatcctcatctgtgtggatttatctacctttggtctttgatactggtgacctttggatggggtttttgtgtggatgtcctttttgttgatattgatgctattcctttctgtttgttagttttccttctaacaggcctctctactgcaggtct

SEQ ID NO: 774 - DNA, 401 bp, Homo sapiens
tgactacagcatctttgctgagctgtggtaggctctgccaagtacgaacttcttggtgctttatttacactgtgaggggaaaactgcctactgaagcctcagtaatggtggacacccctcccctaaccaagctagagtgtcccaggtggacttcagactgctatgctggcagcgagaatttcaagccagtggatcttagcytgctgggctccatgtgggtgggatccgctgagctagatcacttggctccctgactccagccccctttccaggggagtgaacagttctgtctcactggcattccaggtgccactggtatgaaaaaaaactcctgcagctagcttggtgtctgcccatatggtaaccagttttgtgcttcaagccatatttcttttattgga

SEQ ID NO: 775 - DNA, 401 bp, Homo sapiens
atatagtgttagtagctgacgatttttttttcttcaaaaataaatttggaaacttgtcagtccataatttttttaagtattattttactatctcatgaaatctgaaaggctagaatacactagataactcttgatttccactcctaccctgccatgaagtgataattcacatctggctataacttcataaaaggggcaggrcgacccacttcctaaaagaccactattgacttgaagacctgtgtctcttgtctcacttctaaaagtgatttaaaactcaataactcactctgaaatccactgtataagaaatagtaatgtttagggtcatttaaaagaaagattagtttaataaattttggcaccctgtttaacatataaaaccatgaccatgtgttaag

SEQ ID NO: 776 - DNA, 401 bp, Homo sapiens
atgtgattcaaaagactgatttaatagctatagtccaagaagtgttgaaaactcttgcccagtttatggtttccaatataggacacatatcaacagaataagaaactcaagaattaaactgatgactgtgtcgacctctggaggaactcttttttaagacacaaagccaaattttcaccttcatttatgcacactcatctyctgaaggcttmcttatgcatttacgtgtgaaggaaggagaggatttgactcagtctctttgtctgtcatctttcttcctctctcattctgaaatagcttttcacagttgaggaaaaaataaagatttgaccttcccacagtgaatgataacaatgataacagctgatctttatatagtgtttattatatgacagagatca

SEQ ID NO: 777 - DNA, 401 bp, Homo sapiens
aagactgatttaatagctatagtccaagaagtgttgaaaactcttgcccagtttatggtttccaatataggacacatatcaacagaataagaaactcaagaattaaactgatgactgtgtcgacctctggaggaactcttttttaagacacaaagccaaattttcaccttcatttatgcacactcatctyctgaaggcttmcttatgcatttacgtgtgaaggaaggagaggatttgactcagtctctttgtctgtcatctttcttcctctctcattctgaaatagcttttcacagttgaggaaaaaataaagatttgaccttcccacagtgaatgataacaatgataacagctgatctttatatagtgtttattatatgacagagatcatttcatgcact

SEQ ID NO: 778 - DNA, 401 bp, Homo sapiens
tactagcctttttaagatagacattgctgacacatggacagggattgaattagtacaaatattaaatatcattaagccttcttttttgagttctgtctgcacatcaacttcacctgaagaatgtttgtaaaatacacatgcttgttccccacccaaaatctattgaatcagaatctctagggagtgaggaccaacagttgygcttttaacacctccactccccccttgtattggacggtaaaggccagaaaagattaccttaggcattctcatttcagaagctaaaacagacattcaattttctataccctaatttgggacttatatctgagtgttaatatatgcatgtaatactttgtgatgaatgttaaatgtgttttaatagtgttcccttgcagaat

SEQ ID NO: 779 - DNA, 401 bp, Homo sapiens
ttctatctaaggaagatgagttccttagttctgggaaaacaccattgaggaaggatgcttcagaagaggaagggatgtcagccagggcagataaaattagcaagaaatattaagattaagtgctatctaagaggtacaaaaaataatagtgtttcacctcaatagaatcttattgttaaaaatacagtgtatctacagttytgaagattatcaaaacacaatattctagccccaaaacaggaaaagaataatgattcttaagaaaaaattctttctgggctgggtagggtggctcatgcctgtcatcccagcactttggaaggctgaggtgggtggatcatgaggtcaggagatcgaaatcatcctggctaacccagtaaaaccacgtctctactaaaaat

SEQ ID NO: 780 - DNA, 401 bp, Homo sapiens
cagtcattaccatgagcagtcaataattccctgaatccctgttggacagaattacatcaggtacatgtgttgtgatgttttctgttttgagttctgtttgttttttatttattggtaattcagataatctcagtttcaggaatttgttttcttctctcctaaaatggagctgatgttcatctcttccttatgttatacctrtatttatgcaccaatttcatagaaaaccatcgtgcattttcccatggaattttgggtgacagtttaagatcagcgtttactataatgggcagacttaaaatggtccccgtgatccctgactcctgaagttcactcccttgtatgcttccccctctttgaatgtcagcggacctttaacctagagaatacagcagagttgg

SEQ ID NO: 781 - DNA, 401 bp, Homo sapiens
aacaattaatagtcataattgatagttttatgcatgaaaattaagtattgctcctgcaaaactgaggagttaatgtctttacgtgctttttcacaaacattccttataatggaacaccaaatgcctacaatttgaacacatggctggtggaaaaaaagaagaaaaagaaaatcaatcctaagccagaaatctgaaaaaagrcagtgactttgggtcattttgtaatcatctttggtgcttcagtgactaaaaaatacatgcagagtgcaagagcaccttgctgaatcctacaccctgccctccttgtgcagttatgttacatgcaactccaaagcctccacagctgttgtctctactctccattcaaaacaatgcacgtgcaactttcccttgtggctggc

SEQ ID NO: 782 - DNA, 401 bp, Homo sapiens
ttcctgtggagcctccttcctctccaaggaatttgtcgcatgggactgcataattcagttgtccattcagtcaacagtgatttactaacaacctactttgtgttaggcactgttccagggtctgcgcattcagcagtgagcaaaataacacaaaatgcttgctctcatgaacctggagacagacggtaagaatatacagcrataggcaacatggtaggtggggatgagtgctctgaattaaaataaggcaggacacagagatggagagtgacctggacaggacagggttggcagctcagaagtgcattatctacagtggtcagggaagcctctccagtgaaaggacattaagacggagctgaaggaagggagagagtggatgaaagagcaaaatccctgga

SEQ ID NO: 783 - DNA, 401 bp, Homo sapiens
ggatgaaagagcaaaatccctggaactgggacatgcttggcaggttgagtgtccacaagagccccaattaactacaggagggtgagcaaggagagagtagagggagttgaggttagagaagtaaccgtacgtcaaattatggaggactgagtttctcaaactccagtgtctgcgcaaatcccccagggatcttgtgaaacsacaggccttgatttagaagatctgcggcaggcccagggtctgcattcctaccatgcccccagatgatgcccctgcctctaccgttccccagaccatgctttgagtagcagagatgaaggccttcttgcccacagtacaaattctgctatttctttcctgttaatttgaattggtatgcaacaactgtacatatttatggg

SEQ ID NO: 784 - DNA, 401 bp, Homo sapiens
tctgtcccccaggctggagtgcaatgtcacaatcataattcactgcagcctccactcccagggcacaaatgaccttctgcctgagcctactgagtagctaggactacaggtatgcaccaccacaccctgccaatgttatattttttgtagaggaaggttctccctgtgttgatgaggctgctttggatgcttttaaatagwggggaaataggatcagactcatttttagggagcccctctggctgctctgtgaaaayagggcaagggaggaaataggagacctcctgggagataactggagtagtctgggtgagatacttcagtgccagcatctaaggtacttgcaggtgggacagccacaacgaatgccacttcaagtgaatgtgaggatcagctctgct

SEQ ID NO: 785 - DNA, 401 bp, Homo sapiens
cccagggcacaaatgaccttctgcctgagcctactgagtagctaggactacaggtatgcaccaccacaccctgccaatgttatattttttgtagaggaaggttctccctgtgttgatgaggctgctttggatgcttttaaatagwggggaaataggatcagactcatttttagggagcccctctggctgctctgtgaaaayagggcaagggaggaaataggagacctcctgggagataactggagtagtctgggtgagatacttcagtgccagcatctaaggtacttgcaggtgggacagccacaacgaatgccacttcaagtgaatgtgaggatcagctctgctgcccaygtggaaacataagtaaggttgttacctgtggccttgcagaagcctgcaag

SEQ ID NO: 786 - DNA, 401 bp, Homo sapiens
aataggatcagactcatttttagggagcccctctggctgctctgtgaaaayagggcaagggaggaaataggagacctcctgggagataactggagtagtctgggtgagatacttcagtgccagcatctaaggtacttgcaggtgggacagccacaacgaatgccacttcaagtgaatgtgaggatcagctctgctgcccaygtggaaacataagtaaggttgttacctgtggccttgcagaagcctgcaagtcaaaggccttttgatggttggtgaaaatcacatctgatatgcgtgattccaggaagctcatctgcctcattcctgaatttaatttctatccatgaygcacatattactattgcattaaacgtgaagtcattgcctcctgccattgtaat

SEQ ID NO: 787 - DNA, 401 bp, Homo sapiens
cagccacaacgaatgccacttcaagtgaatgtgaggatcagctctgctgcccaygtggaaacataagtaaggttgttacctgtggccttgcagaagcctgcaagtcaaaggccttttgatggttggtgaaaatcacatctgatatgcgtgattccaggaagctcatctgcctcattcctgaatttaatttctatccatgaygcacatattactattgcattaaacgtgaagtcattgcctcctgccattgtaatgtatgcatgctattgcagaggaaatgtttttatctacctcccaaataagtaagcataacttgagctcgcattacaaaatgacacaataaactaaaaaggaattcatttaatatttttaaacatgattttggtgtccttatatttagg

SEQ ID NO: 788 - DNA, 401 bp, Homo sapiens
ttacgttcagatggcacatgtgcaggtttgttacatgggtaaattgcatgttactggggtttggtgtacaaattattttgttacccaggtggtgagcatagcatagtacccaataggtagtttttccctttttttttttttttttttttttttttgagacagaatctcgctctgtcgctcaggctggggtgcagtggtgcratctcagctcactgcaacctccgctcctgagttcaagcgattccccctgcctcagcctcctgagtagttgggatgacaggcacctgccaccaggcccccataatttttgtatttttagtagagatggggtttcaccatgttggccaggctggtctcgaactcctgacctcaggtgatctgcctgcctcagcctcccaaag

SEQ ID NO: 789 - DNA, 401 bp, Homo sapiens
attgttcccttctttgtccccatgtgtacttagtgtttagctcccacttattaagtgagaacatgcagtatttggttctctgttcttgcattaattcgtttagacatggcccctccagctgcatctatgttgagcaattaaaaaaggttaagatgagctaagtgaggtggtatgcatctgtagtaccagctactcaggacrctgaggcaggaggatcacttgagcccaggagttcaaagccagcctgggcaacatagtgagaccccccccatctcttttaaaaaatatttcagatgataaattttatgctgtatgtattttaccataatacaaaattggttgaagaggagtacatataaacacaacaacgaagtgtttaactcatcaatttcagatacaca

SEQ ID NO: 790 - DNA, 401 bp, Homo sapiens
aagtgtttaactcatcaatttcagatacacagtaaaagaatgtatatgagaattggtcaaggacattctgaggctttaagcttcaagtcaagaaaaacaactgcctttctgaaaacttacaccgctcacagagtctggtgggctatgaatttgatggtacaacttctaacttgacagtgtggagatcaagggtataggaawggtaaaaagctttgaaaagtttgagagtggagtttgcacagctggacacagggcaccacaaacacaggtggtgcatttgtgcctttggtggacaaagtatcacccacaatgcacaggcgcttccctggctggacaataggtctctctctccatcccctctctctctgtttcaagagaagacattttacgtaggaccttcc

SEQ ID NO: 791 - DNA, 401 bp, Homo sapiens
tcttagaattgagtccttagaagaaataccaagctaaagggcatgtgaatttctaagtttcctggcacttaattccaaattgttattccaatttctagtgtgccatactacatctttattagcattcaggattatcttcttggttaatatagtaaaatatcattttgttgtttgaattttcattgctttgataattgatgrtatttaaagatgtttaggctctttttttctttttcatttgctcagcttttctgaaaacctttaggagacaagtttctcccaaattttttctactgagatttatgcattactgatatgacttctaacatataagctagttaacatcaagaggattagtctatcacaccacttgtcacctggggcaaggtagtatccagttc

SEQ ID NO: 792 - DNA, 401 bp, Homo sapiens
cattactgatatgacttctaacatataagctagttaacatcaagaggattagtctatcacaccacttgtcacctggggcaaggtagtatccagttcattagggtaaaggtcaagtaagtgttttgtttgtttaaaggggaacacgggtaggagttatcccaaagttagaacgcaatgaaacccaactatatagtaaaatayatttggggctcaactctgttagccatcaaaggtagtacaaaacatcagaagatgaagagggttttgaaagaaagaagggccatgtcagattaagaggtagaggaacatcaagataatttttcttctattagagtttctcttttagggtttctattagagtttctctaatagggggtagagaaacagcaagataatttttt

SEQ ID NO: 793 - DNA, 401 bp, Homo sapiens
tagggtttctattagagtttctctaatagggggtagagaaacagcaagataattttttttctattagaatttctccattagagtttctcacctgcaaggtgttgactttccagttacctggcatttcattctactttttggaatggcctgagctgaaattaatcaggctctgttgatgatgcatccaccagggtttcccaktggatgcttagaaaaaattccatcacagaatatctgtgtcttgtcttcttgggggctaggagatcccccaaatttttctcttctgttcttgtttgataaaggatgtgtggaggacctggtgcttragagtttcagtttgacataaaggtactagttctggagagtctcttgggccactttatgttaacaaagactctctt

SEQ ID NO: 794 - DNA, 401 bp, Homo sapiens
tcattctactttttggaatggcctgagctgaaattaatcaggctctgttgatgatgcatccaccagggtttcccaktggatgcttagaaaaaattccatcacagaatatctgtgtcttgtcttcttgggggctaggagatcccccaaatttttctcttctgttcttgtttgataaaggatgtgtggaggacctggtgcttragagtttcagtttgacataaaggtactagttctggagagtctcttgggccactttatgttaacaaagactctcttgatcagcctttagttaagcttctctgagctctctccttgactaggcttcaaccttgggcttctgtgtcagtccttgtggagtctggttttagcaagaatcttgcaaagtcagtttagagagaata

SEQ ID NO: 795 - DNA, 401 bp, Homo sapiens
tccactgaccccacactctgctctttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttmcttmcttccttccttccttccttccttmtttcyttccacagaatctcgctctgtcacccaggctagagtgcagcggtataatcaaggctcacagcagcctsggccttccaggctcawgtgatcctcccagctcagcctcccgagtagctgggaccacaggcacatatcagcacgcttggctaattcttttttgccttttg

SEQ ID NO: 796 - DNA, 401 bp, Homo sapiens
ctgaccccacactctgctctttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttmcttmcttccttccttccttccttccttmtttcyttccacagaatctcgctctgtcacccaggctagagtgcagcggtataatcaaggctcacagcagcctsggccttccaggctcawgtgatcctcccagctcagcctcccgagtagctgggaccacaggcacatatcagcacgcttggctaattcttttttgccttttgtttg

SEQ ID NO: 797 - DNA, 401 bp, Homo sapiens
ctctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttmcttmcttccttccttccttccttccttmtttcyttccacagaatctcgctctgtcacccaggctagagtgcagcggtataatcaaggctcacagcagcctsggccttccaggctcawgtgatcctcccagctcagcctcccgagtagctgggaccacaggcacatatcagcacgcttggctaattcttttttgccttttgtttgtttgtttgtttgtagagacaaagt

SEQ ID NO: 798 - DNA, 401 bp, Homo sapiens
aatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttmcttmcttccttccttccttccttccttmtttcyttccacagaatctcgctctgtcacccaggctagagtgcagcggtataatcaaggctcacagcagcctsggccttccaggctcawgtgatcctcccagctcagcctcccgagtagctgggaccacaggcacatatcagcacgcttggctaattcttttttgccttttgtttgtttgtttgtttgtagagacaaagtttcac

SEQ ID NO: 799 - DNA, 401 bp, Homo sapiens
tgaaatagtcctgaacaaagtcttccttgccattttcacacgtgccagaataatgcttgcctccctgcctgcctgccttccttccttccttccttccttmcttmcttccttccttccttccttccttmtttcyttccacagaatctcgctctgtcacccaggctagagtgcagcggtataatcaaggctcacagcagcctsggccttccaggctcawgtgatcctcccagctcagcctcccgagtagctgggaccacaggcacatatcagcacgcttggctaattcttttttgccttttgtttgtttgtttgtttgtagagacaaagtttcactatattgcccaggctggtctcaaactgctgggctcaagcaatcctcttgcttcaaggtcccaaagtac

SEQ ID NO: 800 - DNA, 401 bp, Homo sapiens
aaagtcttccttgccattttcacacgtgccagaataatgcttgcctccctgcctgcctgccttccttccttccttccttccttmcttmcttccttccttccttccttccttmtttcyttccacagaatctcgctctgtcacccaggctagagtgcagcggtataatcaaggctcacagcagcctsggccttccaggctcawgtgatcctcccagctcagcctcccgagtagctgggaccacaggcacatatcagcacgcttggctaattcttttttgccttttgtttgtttgtttgtttgtagagacaaagtttcactatattgcccaggctggtctcaaactgctgggctcaagcaatcctcttgcttcaaggtcccaaagtactgggattacaggcatg

SEQ ID NO: 801 - DNA, 401 bp, Homo sapiens
gtagctctttgaaaagactgcttgatctttcctcactctccgtgtacctaaatcttgttcaggctctgtccagaaatcaataggaaacataaaaccttgaagcattataaaatcaggcattctaaactggaaagggcctttgattatttagcccaaatgcatcacctgttttacagacgagcaacctgaagttcggagagstggaacttcctccaggtcatctgctgcactggtgatagaggcaggactaaacactctcggtgcagtgttccttctctgagtcatgttgactactatatgctcattcacagtcacaaactaaaaatctcagacaagtcaaaagcatacaattacaggaccagaagactcctcagtgattatctgggagtccaggcatccaa

SEQ ID NO: 802 - DNA, 401 bp, Homo sapiens
ttgtcttcctataaagagtttttatggcgaacagaaagctgtctggattcttgctatggttgtaggcaggagggaacatggtgtgtggcttctgaacaaactctggctgctctttaagttcaatgaagtgaaaaaaaggcaagttaattgactacagacatatgcaagagagctctcaattgagccataagatcttttggratgtgggtgtttacaaggtagctataagcactctcataagtactgcacctgtgaatcatggactttcattgtacatagctttccactgcttgcttcttgaggctactgttcagcccatcagtaatttttaaagatcctttagaaagttatatagaggaatgcaaatgtgagtaaacaaggcgcctctacctactgatggc

SEQ ID NO: 803 - DNA, 401 bp, Homo sapiens
actatgggtttcatttcatacagtcatatgaaatgaaataattatgtatacaattatatatatatacatatatatagagagagggtgtaaatatataatttattcttaatgctcaatcttatcagagctgaaagatggttacccatgaaggaatcaatgacaccatttcacatatgattgcagttaccattcccttgtagktgctgggctagctctctcagctttccgagatttttttgaggctcagaggacctcctctcctgaatgagaactgggttctaacgaatgaccctaactgtgccctgttacagtggctctgtcttatgcccacgtgaagtgatgtcacagaccatattcacgatatcgaagctacacattactaaaccttctgccgacccaca

SEQ ID NO: 804 - DNA, 401 bp, Homo sapiens
ggaaggagaagttctttcttattcaggggaaggtcgccattttgttctcttcgtgtcttcaactgactagatgagatccagttacatgaggtagggcaatctgttttagtcaatttatatttaaatgttaatctaatctaaagccaccctcacagaaacaccagaataatgcttgaccaaatgttgggtctcctcataacrtacaaagttagccatcacgatattttcctggcatacactgtgaaaccactgacctggaaccctctgacttctgtcagctatttaatagataagtctttctaatcttgagtgtttgtaaagcagttggatataaatttgaaaatttttaaatgaaacgataaatcatgtgtgacctcttgagcctattaatcctaaagtaa

SEQ ID NO: 805 - DNA, 401 bp, Homo sapiens
ctgtggttggtgatatgaagaaaaccatatgtgatagattctaaatatataaccacaaaagccaaactgacggtttggaacatctcagcaactattattgattactacagttgaagaggttgaatcagtttgcatggcaattctcctcctcttcttcctcccatacccactcctcctctttcttatttttctctcttgctytctctctctgttctccattcgttgtttctttctaattcgcagtagcagtagcagcaaccagaaaaatatttgagaactttaaactaaatggttaactaataaggcaataaatagaaggtgtgacactgaacgaggagtaaaagccaatgcattccactacattgagagacatttatgaagtatattgagttacacagaca

SEQ ID NO: 806 - DNA, 401 bp, Homo sapiens
gggctcggtggctcacgcctgtaatcccagcaccttgggaggccaaggcaggctgatcacgaggtcaggaatttgagaccagcctgaccaatatggtgaaaccccgtctctactaaaaatacaaaaattagccaggtgtggtggcacacgcctttaatcccagctactcaggaggctgaggcaggagaatcgcttgaaccygggaggcagagtttgcagtgagccaagatcatgccactgcactccagcctgggcaacagagtgagactacgtctaaaatataaaataaaataaaataaaataaagactaaaaatggcccccaaaagatatcaggttaaatccctggaacctgtgattgttccgttatatgataaaatatatgatttagttaaggatcccc

SEQ ID NO: 807 - DNA, 401 bp, Homo sapiens
gtttgatttttaggaaaagccattttattttaatttttttctatttttttatttttattttttacattgaggttctctttattttttactatttcttttttcttttcgtcttcttttttttttttttttttttgagatggagtttcactctgtcgcccaggctggagagcaatggtgctatctcagctcactgcaacatcygcttcccgggttcaagcaatttcccacctcagcctcccaagcagctgggattacaggcaactgctatcatgcccagctaatttttgtatttttgtagaaatggagtttcaccatgttggccaggctggtcttgaactccttacctcaggttatcagcccacctgggcctcccaaactgcttggattacaggcatgagcta

SEQ ID NO: 808 - DNA, 401 bp, Homo sapiens
ggaaagaattttaaagagacttgggctgagtgcagtggctcacgcctgtaatcccagcactttgggaggcccaggcaggtggatcacgggtcaggagttagagaccagcctggccaacatggtagaacctcgtctttactaaagatacaaaaaattagccaggcagggtggcaggagaatactcaggaggccgaggcaggrgaattgcttgaacccgggaggcggaggttgcagtgagccaagatcgcgccattgcactccagcctgggtgacagggcaagactaggtctcaaggaaaaaaaaaaaaaaaagagagagagagagacttgatggttttctcttgaaaaaataatctcttagccattttccactgccacgagtacatgtacattgaaattagt

SEQ ID NO: 809 - DNA, 401 bp, Homo sapiens
gtgcagtcattgaagatttgtagaccagaacataacatattgaaccccatatctatctatatgccagtgtgtgtacttacatattaatttctcctatgaaagaggaattaataggaaaagaaaagcaaggaagtaatgttcaaaacttccttaatggccaggtgcggtggctcacgcctgtaaccccagccctttgggggrctgagaggggtggatcacctgaggtcaggagttcaagaccagctgaggtcaggagttccagaccatcctggccaaactagtgaaacctcgtctctactgaaaatacaaaaattagctaggcatggtgtcaggtgcctgtaatcccaactacttgggaggctggcacaggagaatcgcttaaacctggaaagtggaggttg

SEQ ID NO: 810 - DNA, 401 bp, Homo sapiens
ccactgtctctgctttcttttatggctaacaagcctatactaccacaagccacatttcatttgatagcatgggtagtggaagagagcatccaaagccagtcaatcctaaatcatgtctgcaaaaatatctgtaaggataaggcctggtggacctcaagaactgtctccctctagtaataatcatataacattattattttkcagtgaaaaattatccagtacacaagcagtctatgcaatgtaatgagaagaatgctttgcaactgtactactagaagcgaactaattcatgatttatttttaagtgattagaacccttagtttatctgtgagaacatcacttaaataaaatgttttaaaatatgcaatgcatatgcaatagcattaaagtattaaatagc

SEQ ID NO: 811 - DNA, 401 bp, Homo sapiens
agtattaaatagcatcttaaagagcaaaagaaactattaagaataattaagtggatttattggctaattggtgtttccacatgtagttatttctgcaattattattcatttgctgatttacatagagctattctctaaaattactctggcattaaatgaagttagaagacatctccagtttggaaaatctattaagcaaakccttttcaacttaaagttgaggtgatactgaatcaaggcctggcagaactgactayagactcagagggagtatgtttattgcttttaattcttcctatttctgtttgaactaacatggcaaaggctttcatmttccaaactacacttatccagtctataaaacaaagatgatattgtttcaactataaagcacagattaa

SEQ ID NO: 812 - DNA, 401 bp, Homo sapiens
ttattggctaattggtgtttccacatgtagttatttctgcaattattattcatttgctgatttacatagagctattctctaaaattactctggcattaaatgaagttagaagacatctccagtttggaaaatctattaagcaaakccttttcaacttaaagttgaggtgatactgaatcaaggcctggcagaactgactayagactcagagggagtatgtttattgcttttaattcttcctatttctgtttgaactaacatggcaaaggctttcatmttccaaactacacttatccagtctataaaacaaagatgatattgtttcaactataaagcacagattaactttgggaggctgaggcaggcagatcaccagaggtcgggagttcgagactagcttg

SEQ ID NO: 813 - DNA, 401 bp, Homo sapiens
ctctaaaattactctggcattaaatgaagttagaagacatctccagtttggaaaatctattaagcaaakccttttcaacttaaagttgaggtgatactgaatcaaggcctggcagaactgactayagactcagagggagtatgtttattgcttttaattcttcctatttctgtttgaactaacatggcaaaggctttcatmttccaaactacacttatccagtctataaaacaaagatgatattgtttcaactataaagcacagattaactttgggaggctgaggcaggcagatcaccagaggtcgggagttcgagactagcttgaccaacatggaggagccccgtctttactaaaaatacaaaataaccgtgtgtggcggtgaatgcctgtaatcctagc

SEQ ID NO: 814 - DNA, 401 bp, Homo sapiens
ttgatacctatggaggaatacattctaaaaataagattttatatctgtttgcatgttaacaaaacttatttgtaaagacacacattctagaaagtaacctcaaaagtactcttataaagcacctcattttgaaagtcaagtagagcaattcctgggcagatgataatgatactgcagagacatgtgaagaaggaaaaaaartaataatttcgctccctgtgttagtctgttctcatgctgctaatgaagacatacccaagactgggcaatttataaagcaaaagagatttaatggactcacagttccacatggctggggaggcctcacaattatggtagaaagcaaaggaggcgcaaaggcacatcttacatagaggcagtcaagagggcatgtgcagagg

SEQ ID NO: 815 - DNA, 401 bp, Homo sapiens
caaaggaggcgcaaaggcacatcttacatagaggcagtcaagagggcatgtgcagaggaactgccctttatcaaaccaccagatctcgtgatacttattcactatcacgagaacaggatgggaaaaacccactgccatgattgaattcccttccactgggtccctcctgtgacacgtgtggattatgggagctggaattasagatgagatttgggtggggaaacagccaaaccatatcactccctaagactattacatttcagcagttagatgaagagagaaggacagggttcagattgaatcattttggatggaggagaacatataaataattgaacaataggagcaccacctagtttagagacaacctaccacaggcaaatacctcacatgacttcatt

SEQ ID NO: 816 - DNA, 401 bp, Homo sapiens
gaagatacttctacagtatcccacagttccacaatctctgattcaggaaattacattaaaagttatatgttggcattttggaatttcatttggtatacatacctgcagacagaggcaataaaatcacatcaatggtcggttacaaatgaagtcatccagttgacccagggtatgctttggctaaattttgttttagatttkccctaaaatataattgcaatattgaatatctctaatagatctcaagggccctctattagtccattttcrtgctgctgataaagacatacccaagactggacaatttacaaaagaaagaggtttattggagttacagttccacayggctggggaggcctcacaatcatggtgaaagtcaaggaggagcaaatcacatctta

SEQ ID NO: 817 - DNA, 401 bp, Homo sapiens
ttggcattttggaatttcatttggtatacatacctgcagacagaggcaataaaatcacatcaatggtcggttacaaatgaagtcatccagttgacccagggtatgctttggctaaattttgttttagatttkccctaaaatataattgcaatattgaatatctctaatagatctcaagggccctctattagtccattttcrtgctgctgataaagacatacccaagactggacaatttacaaaagaaagaggtttattggagttacagttccacayggctggggaggcctcacaatcatggtgaaagtcaaggaggagcaaatcacatcttaggtggatggcagcaggcaaaaagagagcttgtgcagagaaacctccattttgaaaaccatcagatctcg

SEQ ID NO: 818 - DNA, 401 bp, Homo sapiens
aatgaagtcatccagttgacccagggtatgctttggctaaattttgttttagatttkccctaaaatataattgcaatattgaatatctctaatagatctcaagggccctctattagtccattttcrtgctgctgataaagacatacccaagactggacaatttacaaaagaaagaggtttattggagttacagttccacayggctggggaggcctcacaatcatggtgaaagtcaaggaggagcaaatcacatcttaggtggatggcagcaggcaaaaagagagcttgtgcagagaaacctccattttgaaaaccatcagatctcgtgagactcattcgctatcatgagaacagtgcaggaaagaccggcctgcataattccatcagctcccacgggttcc

SEQ ID NO: 819 - DNA, 401 bp, Homo sapiens
accatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggcatgcagagagtagtctgaatgctattgccacagtggttttatwtttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggccgagcacgggggctcacgcctgtaat

SEQ ID NO: 820 - DNA, 401 bp, Homo sapiens
ataaaaattagtaaacagaagtaactgtttaatgaaaatgaagtatttgtatttctatttatcaagaaagaaaagacgaacctgtggccgagcacgggggctcacgcctgtaatcctagcactttcggaggccgaggagggcggatcacctgaggtcaggagttcgagaccagcctggccaacgtggtaaagccctgtctytgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtytccaaaaaaaaaaaaaaaaaaaaaaagagaaaag

SEQ ID NO: 821 - DNA, 401 bp, Homo sapiens
agaccagcctggccaacgtggtaaagccctgtctytgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtytccaaaaaaaaaaaaaaaaaaaaaaagagaaaagaaagaaaagaaaagatgaacatgtaacttacacaaaacacttgttgccatttaccatggggatataatgaactaacattcagaagtcacacatatgctgaagaagcatcaggatctacttcaaaagttaaaaacattaaaaaaaaacacagaaaaaaagagtgcat

SEQ ID NO: 822 - DNA, 401 bp, Homo sapiens
tttgggaggctgaagcaggcagatcacttaaggacaggagttcaagaccagcctggccaacaggagaaaccccgtctctactaaaaatacaaaaattagctggtcatggtagcccacacctgtaatcctagctactagagaggctgagaatctcttgaacccaggaggcggaggttacagtgagccaagaacatgccactrcactccagcctgggcgacagagagagactctgtctccaataaatacataaaaataaaaataaaaatttaaatattattgattaaagataagaatgaattagttttgtcactaatttcatacatattaaccatatcatgccactttgaagaagattgtaggtaatttatgaaaaatgttcaaataagactgtattttttta

SEQ ID NO: 823 - DNA, 401 bp, Homo sapiens
ggacaagctttatagtcctagcacttgctgattctttaaatactgtgctttggtccaggggatgttaccttaagcccattttttgtagttagtaaataagacttcttcccaaagtcacgtgcatgttcaagttcttgcattgccagtgtgtaatggataaagacaaatgtatagtaaaaaaatcatgaggcagtctttggktctcatcccagccctgttggctgtgtgatatttggcaaattattttacttctctgagcctcttttctttccattgtaaaatacagagaatgatagttaagagtatttttgtggaaatgaaccaacacaatgcagctcaagtatcttagcagagtgcctgtgttcaataaatattaataaaatgacccttaactcccctca

SEQ ID NO: 824 - DNA, 401 bp, Homo sapiens
ggaaatgaaccaacacaatgcagctcaagtatcttagcagagtgcctgtgttcaataaatattaataaaatgacccttaactcccctcagcaagtttaaaaacaggaagtttccatttcaccatttactttccaattctttgttaaagatggccataataagtaatgagagtgtgcatttgtaaatgtctgtcaccaatgkgaatttacttgagatgactcaaaccacattctatactggaaaaggtgcatttaacgggcaaaagaaaagcccaggccagtttctttctgtatcaaccctgggtaaatctccttaagaaaaaattaacaatcatgatttattcatagggaaagaatttaactacttgttagcattcgaatgggtcctaaggaaactcccaa

SEQ ID NO: 825 - DNA, 401 bp, Homo sapiens
ttttccgatgaagtttttttgctggtccaaatattaattaatcgattgattgaaaatgctacaaaagaggagccattcatcaaagaaccaaatccagtgattcgtgatctggggttttatcacttatatttctagagcatccttttgcttttacaacttaaatttaattgaaattttaatccctagcaggtttttaataaygggcagcttttgagacattaaaaaacattgctctcacttcccagataaggaggttgtccagatatccttatgctttagggagcatttactaagtgatggtacttcccagcgcacatttttggttttgttaaagtatcttaaaccgcccatgtgtagtcaacttccccttatggaatccattgataaatcatggcaaaagg

SEQ ID NO: 826 - DNA, 401 bp, Homo sapiens
caaatcaaaagactagatgtagctaattagacatgggaaaagggtggttctcctgaaaatctggggcctcaggcattttctggaatgtgtacagtcagaacgtgcaagttagtcagcaaagagaaaacaagcagccacacctctcccaaataccgaatagtcatccttcttttgtggttcagaggtgtttgtttgtcttakaatgctgcaacttaaaaccaattgattttaaataaaaatggtaacattataaagtgtgaaagtgtggggttaggaatcatttcccaccctgtgaaaatggctctatggtcacccaggggtgtgtgtgtgtgtgtgtgtgtgtgtgtgtgtgtttgtgtgtttaacctgtgagataagaatggtcaaccagttgactcctc

SEQ ID NO: 827 - DNA, 401 bp, Homo sapiens
actgattgttgtctccaaaacatgttctatcttagacactatctcatcctcttctctgccagatattgattattcatacattctctgatcccaaccaccagctttactcattgttatgtctttgtagctttttcttcccttaaatacaaggacaacctattatttccacaattcagcactttttactgggtcttttacctstctaaacccaacaagagcatcaaagcatgatgttgggcttggtgcctctcttccaccattctttctctttttaactccacatgtgtgctggactcttgcttatgatcttccctgtgtagctaccaccacaaaaatgtgtccccggcctttacaaatgaagtgttcagatgcaagccattctcttatagacatggcagtaa

SEQ ID NO: 828 - DNA, 401 bp, Homo sapiens
atagcccttaattaccagagacttggaactggaggctacactggacctgatatatacacttaacaaagtaacgcttatgtgcctgtggttttacacccccccaccccaaatatctcctagtgactcccctagaaaatgtactgccctggccagattttctttttgctgtcatttcttctcaaatgtattatcattcattgwctaaaaaatataaaagccccttcttcagacttcactgtcttgtgaagatcttcatgtacacgtgaaattaatcaaatgtgtatacttttctcttgttaatctgcctggtgtcgatttggtttctaggtcctgctgaggagcccactaagagctaaaaggaggattgggggtgatcactggctctcctacagttatgccct

SEQ ID NO: 829 - DNA, 401 bp, Homo sapiens
cagagaactacacttgctaagttcagaatactttatcagcttactttgtgtccttgttcccatggtggtgacaccgatcttgaagcttaaaaaatcccccaaattccgcctcccacctctgtgacactcttttgcaaaaatatgcaatttttctacacacatttctgacaaaaaggaaaaaaatgttaagtccaccctagktctgtccagacaagcacagagagaggcgtgttagatttccagacaaatattttcgcctagattttgctcaatgaacttgattcactgcagggctttttttcccacaagcgcgtggcagaggtgggctgccacaggagtggccagtgcccgctctctgcagggcactgctatgaatcaccattttcatgaatggaaagaat

SEQ ID NO: 830 - DNA, 401 bp, Homo sapiens
cattcagtgagaatgcaggagaagtctaagaattagaaggaacaaagaaaagagaatgagcacgggaataaaagtaaataataatcatgtctattcttgattctggggactggctaacttctgtcactttaaaccacttcacctcatttgaaagtccaggcttctcagcttgatgtccaaggttctccatgacacatatcytcttgagcacttcacttcatgccccgaccaagcttggacttcttccccctcacatgcttgctgtttcatgtttcatgttttagctcatgctgttccctctacctggaacatcttggttcactcaactaattctacccatcagaatttagcacaggtgtcctcctctcttcatggtcttcctaaatacctcttgggttcat

SEQ ID NO: 831 - DNA, 401 bp, Homo sapiens
caactacttcctaaagttgaaattgcttccgatttcttttttctctatttcatggataatccatgcagtgtttgctcaacctgtttacactgagatgtgttgaggaactgtcccacggcaagaccacaaggtggggcagtaatgagtaattggaagaaaactgcggtaccttctaaagctcaaatgtggctttctagaacmcgatgaagtggagccctacattcattatttgaccttggttgttttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagcc

SEQ ID NO: 832 - DNA, 401 bp, Homo sapiens
ccatccttcctgtttgccttccttccttccttttggattatgttgtttcattaaaatatatttagctgggcatagtggctcacacctgtaatcccagcactctgggaggcagaggtgggcagttcacttaaggtcaggagtttaagaccagcctggccaccatggtgaaaccctgtctctactaaaaatacaaaattagcygcgtgtggtggtggacgcctgtaatcccagctactcgggaggctgaggcaggagaattgcttgaacccaaaaaaagcagaggtttcagtgagctgagatcgtaccactgcactccagcctgggcaacagagtgagattccgtcatatatatattcacatgatttaggaaattctgtatttcagcatcacagtataaagac

SEQ ID NO: 833 - DNA, 401 bp, Homo sapiens
gctgaggcaggagaattgcttgaacccaaaaaaagcagaggtttcagtgagctgagatcgtaccactgcactccagcctgggcaacagagtgagattccgtcatatatatattcacatgatttaggaaattctgtatttcagcatcacagtataaagacttaagttctaagagttgatattgctgtagatgttgggaatgraatcttaggagtaacctttaccggaggcaacttctactgcccttgctacctttggtgtgacctgaaaccccctttcttcattagtaccaagtgacttgtttgccactactcagctgtcccagaatagcttgactccacacatccatgcatttctaggaagaaattaggtgcattataaataacgagtcctctgaaaatgc

SEQ ID NO: 834 - DNA, 401 bp, Homo sapiens
aagtatgagcttgggccttgtctgacaataaaaaggaaatgctaggtcccagggaccacttcaagatgtgcttgttcctttaaagcagggagttgtcacatccaatttttaacacatatgtatattttaacacatatgcatattttaacacacatatatatttctgattatactgtaaaactggtaaattatttttaaaamatcataaggcccccaaatcccagagaaagttgtttctattacaattttagtctatttgtctcttttaagtttctcttccctctgagcatatgtatctctaatgcatgtctgcttatgtaggcatatttatacatacaccctttcttttacaaaactgatatcaatttttgtattttaaataaaatacaaatgttttacat

SEQ ID NO: 835 - DNA, 401 bp, Homo sapiens
ggctccagcaataagcctaatgacctctacaaagctgttctgtaatacagaagtaaacacttactctgcacaatttctccttgcatgtgcttcccactggtagaacattattcatcttgttggtctttccaaagagattcattacttccttgctccttcttattcatccttcataatagaaatgctaaaagtctgaaagaygaggaagggagcacatttcctccctgcagtctgaggaatggctgtatctcttcatgagcaccaagaggaagcccccagatgggtccctgtccttacagccttgtttccatgtgcatttccaccccagcctcttccataatcgctccccatctctatgccccagcgatgccagttgttccatcaaacactgtcctctctgt

SEQ ID NO: 836 - DNA, 401 bp, Homo sapiens
acaccttcatcacttgaggcccagataggagtgactgtgcgatgtaaaaaaggcttgccaacaccactgatgtttgacgtgaaggtgaaaagttcagtggcccagagaagtgctttaaagggttcttcttaaatctaacacctgaaggaacaccttcagattatccagcagttgtgatcccctatgcagtgtctatttgtmtagacttcttccccaacacacattccctagtacatttaaatggaaagaaaggtctgggaggttatttgcaggggtgttgatggaaacaggacccatcacagctagggtcatgttatcagagtgcagattttgaattcctttctgcctttcctgcatgactttaagtaagaaaatggtcaccttaaatttgcccaataaga

SEQ ID NO: 837 - DNA, 401 bp, Homo sapiens
acaggacccatcacagctagggtcatgttatcagagtgcagattttgaattcctttctgcctttcctgcatgactttaagtaagaaaatggtcaccttaaatttgcccaataagactcagcttggaaatcattcttgggatgcagaaggatctggtccagaaagcttcagagaagccttgagaactgcctattcaagaggrgaagaaggctgagagagggaacctgcaaagatctagcaggaaaagagtcttctatgtgcaaacaacactagaccctttcccagaattggggcactaacaaaagataatgcctctgaaatattgggaaaattgttggagaatatgatctcgttccctatgctgtcactccaggtaacacccatgatgctcaaaggattttt

SEQ ID NO: 838 - DNA, 401 bp, Homo sapiens
actttatttaacaggtagaaaattatggaaattattataccaagaaaggacataggctaataacataaattaggcttaaggagagtttcataaattatgtatctccaatggattaatgaaggaaattaggaataatttttatattatctctacttttttacttatatatttggacttgaggttttctgcatataatatgcrcactaatataaatattaatataatgctaatacaaaggaatactctctcagagattgtgcattaatgtatgtttcagtgacaaaatatagtgcgtgaccttagccccaggaggaagaataggatatgtgaaagaacctaagattttgracccaggataacctggttttaagcccaggtctgctacttaagagctgtacgac

SEQ ID NO: 839 - DNA, 401 bp, Homo sapiens
ctctacttttttacttatatatttggacttgaggttttctgcatataatatgcrcactaatataaatattaatataatgctaatacaaaggaatactctctcagagattgtgcattaatgtatgtttcagtgacaaaatatagtgcgtgaccttagccccaggaggaagaataggatatgtgaaagaacctaagattttgracccaggataacctggttttaagcccaggtctgctacttaagagctgtacgactgtgagcaagttattttaaattgctggatcttgttttcctcatttacaaaatagaaacactgatatctgcatcatacatcatactattgttatgatttttaaattaaaaatatatgccaatgaacctagcaattggtgaccatattg

SEQ ID NO: 840 - DNA, 401 bp, Homo sapiens
gccacccattaatcctatatattggttctaggacttattcctggagttatatcctgcacattggcttcaggcatgaaggacttgatcccacatcttctccagtgggattgtggagatcgtgtcactgctggcctgtcctgcaggctcttgtggtgatcattataaaagccagccctggggtagctcaggacaggaaaggarggatattctgaaatgattttctccttttagttaacacattttggttccagaacactgagcaaatcatcaactgaagccccatgatatattttcaaagagtgaatttctcttacctgactgaggcattttattctataatagcaattctctgggttttttttttttttcatacttataacaaagcggattaatatatactc

SEQ ID NO: 841 - DNA, 401 bp, Homo sapiens
tctgaaatgattttctccttttagttaacacattttggttccagaacactgagcaaatcatcaactgaagccccatgatatattttcaaagagtgaatttctcttacctgactgaggcattttattctataatagcaattctctgggttttttttttttttcatacttataacaaagcggattaatatatactcacctaaracaccaaagatactgatggctttcaccactctatctaagcaggagtaaacacctgggaactagaaatctgagaaagaggacaacacccaacaccacctaactatggccctcgatacagtcatttaacttaataaccttccgtgagagtaaggtcattatgaaatatgctcggttttacacaaagctttaaaaaaagccac

SEQ ID NO: 842 - DNA, 401 bp, Homo sapiens
tgtttttaaagagctttggatacctgctgtggttaatgtgtcactcactgcgaagctttccaaggcaattattttgatcagaatgtcactcagagttagtaggctggcttcatgaatcatttggggagggtagtataattcaaatttgttatgtattgtcaaacatttaaaaagaataatagtataaaacaaaatacttgyttttacactaaaatttaacatcttttttttttttttctgggaaaatagaatgttgcctaaactgaagtccaaacaactttactttttaccttttcaaatatccatgtggcatcaagccaggccatttaaaatgacatccagttatttaattttaaattcattttgtagaaatcccacctctctggggagtatgtacagca

SEQ ID NO: 843 - DNA, 401 bp, Homo sapiens
gaaagtgctcaaaaatatttgttgagtgaatgacagtagagaaaataaaaatgtcctggattggaatcatgaaaactgtctacttatctctaatattaaaaagctcagtgtaatcttagaaaaaataatctgagagctctgacactttccagaggccacttccacgggaaaggaggagcaaagtctctgatcagaagttgrgtaaatatcctctgaggtccctgattatccagacattgacaaaagaaaggctctccaaggtttgccattattactataaggaagtcccagctcagatgattcatagttaaatatttgcatctcctctggctaagaaaaataaaagccacgacattccagagcctttaggcatgtaagatcttggtactttcccagttatt

SEQ ID NO: 844 - DNA, 401 bp, Homo sapiens
acacacctaccctcactctccacccacccacacacacacacactggaaattgtatcatacacacaccggaaattgtacccaaaggacgctattactaactatgaagcaagtggcacccatggcttgtccagagaagacacccacagggtcagacttcacacaacaagcctatgaatgggatagcccacatttaggagtggwcttctaatccagaatcttctctttatttagttcaagataacataaacttcctttttgtaaatttgtccatcatccactcccttgctcttatactctagtgagggggaggtcagatgataaatgacaaggaagatcatttccagccgtgatgagtgagatgcggaaaacagggcagccatggagcagcgagagaacaacca

SEQ ID NO: 845 - DNA, 401 bp, Homo sapiens
ttgttacatctggctttaagtctccaatgagccctggggaactcaatcccatcaaaggaatttcgagaggagttcacagctcctatctaccatagaagggagaaacaggataaggaatagatccctgataaagcacatgaacaaattaaatccattgttaatttgagtgactggcatagagaggtggcccctacaaaattstcactttttagagtcacggtggttcacagaagaatagaaatcatcttttcctcttaacattatttccatgtactacagttccctctccctaaagtggtctacttgcatttgtcaacactgaaagcaaaaacaaagttgaatatacacccatggtgcatattgttaataaagaagatggaggcaattcagtggtattctaa

SEQ ID NO: 846 - DNA, 401 bp, Homo sapiens
acacatgtaaaaaataaaaaataaaacaatatgcatgtatgcatacatacacacacacacttttagctctgtcttgagctgtcatctcctggggcaggcttaatgacaggtgcaattctggcctaattcaacctcttgaaattgaaaagggttagcaccactcagtggctgctaaatcctagagggcaaaacagcctcctrtgtctcatcccttcatgactgtctcatgggagctcgatttctgtctctttccacctgctaaccagattcgattttgatgctgtaccattggtagtaaaatatacttctttctggtaaaaggagacctgagaaagtagaaatggcattatttaaaggaatttatacataccatataagttggctggatggaccagccaaca

SEQ ID NO: 847 - DNA, 401 bp, Homo sapiens
attttttatgtcatcccctggttctacagaagactgtaaggacagaggaatgaggcatttcgccttgggatcttcagactcagatttctgagtcaggtttgaggttcctgctgtcctgtgggcagtgaggcccagggattacaccaaaggagcaggaacccaatgtcacaggtcccctaactcctgcctagttgcccaggycacataggmacaggcaggggagctggctgatctcatttgtttgttttccgtgtccgttctcaggcagtgataggcatgctatcatctcaattcttaaataaaaccaagttgtatcgttgaagagcagataaagcaaagacagaagcattttaaaaggaattttgtggcttccaaagtacaagtatagagtatttctgagt

SEQ ID NO: 848 - DNA, 401 bp, Homo sapiens
gtcatcccctggttctacagaagactgtaaggacagaggaatgaggcatttcgccttgggatcttcagactcagatttctgagtcaggtttgaggttcctgctgtcctgtgggcagtgaggcccagggattacaccaaaggagcaggaacccaatgtcacaggtcccctaactcctgcctagttgcccaggycacataggmacaggcaggggagctggctgatctcatttgtttgttttccgtgtccgttctcaggcagtgataggcatgctatcatctcaattcttaaataaaaccaagttgtatcgttgaagagcagataaagcaaagacagaagcattttaaaaggaattttgtggcttccaaagtacaagtatagagtatttctgagttaatgaaga

SEQ ID NO: 849 - DNA, 401 bp, Homo sapiens
atatttaattttctaattatgtgcgaaccttggagtcaggattagttgatatttttacaccttcaaatttataaacctagtatgaagtcccatctagactaacaaatgttttataatagaaatttaaatagtactccagttttgtttatgcatttgctgatggtctttcttgctatgaactttagaaactttaaatgtccrtttactcacaatacacacacagcctcaatgacctaataagcagatttgcagagccataaccttgctggcttatgtcagctcgaagtaaarggggaggtggtagtggtgaatctgtttttattactcagtgtttaatcataatgaatcagaggcttttatgagaaaccttctacatcccatgaaagatttgctgatcaaag

SEQ ID NO: 850 - DNA, 401 bp, Homo sapiens
catctagactaacaaatgttttataatagaaatttaaatagtactccagttttgtttatgcatttgctgatggtctttcttgctatgaactttagaaactttaaatgtccrtttactcacaatacacacacagcctcaatgacctaataagcagatttgcagagccataaccttgctggcttatgtcagctcgaagtaaarggggaggtggtagtggtgaatctgtttttattactcagtgtttaatcataatgaatcagaggcttttatgagaaaccttctacatcccatgaaagatttgctgatcaaagatgtagagatttctgttttattagaaaaaattgtttagcacctcattgtggatacagaagacattgtttgttgaaaagtttaagtctttt

SEQ ID NO: 851 - DNA, 401 bp, Homo sapiens
catttagtttgttagatatttaaatctactagacaatctattatgtattctgctcagaaatggttaagacctactgatctagaagacggatctctctgagccataatttctgctcaaggcttgctaggggagatccttctaacttggctttatacacaagaagctagctcacaaaaatgtcggtattctagtagctatgcstttcattgaccagacctgagatttggcctctccatcacttcctctgcaggtgatgtagacatcatttctgctgacatctatgttgatgcagttctagagtcatctgtgtccctattatcctgaaaatgaaaattgatagcaaaggcagataatgtccatttagttctgggtgtaaatgtcttccttgctcttccattgtg

SEQ ID NO: 852 - DNA, 401 bp, Homo sapiens
ggttcatgccattctcctgcctcagcctcccaagcagctgggactacaggctcctgccaccacgcctggctacttttttatatttttagtagagatggggtttcaccatgttagcccagatggtctcgatctcctgacctcgtgatccgcccgcctcagccttctaaagtgctgggattacgggcatgagccaccgtgccyggccaagcatttatcttttctttgtgtcagcaacattataattcttttcttctagctaattagaaatatgtaataagttattgttaactataatttccccactataatatcaaatactgtaagttattccttatatctaactctatttttgtacccattaaccaactgttatttacccctgctcytctccttcccagcat

SEQ ID NO: 853 - DNA, 401 bp, Homo sapiens
atgagccaccgtgccyggccaagcatttatcttttctttgtgtcagcaacattataattcttttcttctagctaattagaaatatgtaataagttattgttaactataatttccccactataatatcaaatactgtaagttattccttatatctaactctatttttgtacccattaaccaactgttatttacccctgctcytctccttcccagcatctgataaccatgatttcacgctctatggagatccttgctttgatgataaattcattaaggacaagaaccctgcagggtgttcaatatgcttcccaggtgccaaatagtctcaatacatattaacagaaagtcagtgtcaactcacctgcacctcacacagtaaattgatttaggcatctcagatt

SEQ ID NO: 854 - DNA, 401 bp, Homo sapiens
agccgtgttgttgcttttccatggacttggaaaacatgaagttgtgtagccgtgtgtctccagacttttaacagcccagaaatggtttcaatgttctgcattaaataaatcgagaagggttagacaaaacagtgtctgaaagatttcatgctgtgagggtgatgagggtgatgggtgacattaatgaatctgaaatggtcrtgactacaaacttgtttttaaaatgtcactttctctaagagaacaaaaacttgaaactcaatgttcatgaatacaagaaggccttttcaaagaaaggccacgggcactctcactaatacacacttggcatttgggtatatccctaagctgtggactgtgtttacatatattactctttcttctcatcactctttaaccaa

SEQ ID NO: 855 - DNA, 401 bp, Homo sapiens
cccatagtcctctatctttaaggaaaatcatggcacttgtttttgaatttttttaatccatcttccagattccaaaactaggaattccaaatgttgtttggacagactgaaaagagaacaaccaataggagaagtggtacactatgagtagtcaaggtaccatacacatgggaagtgtgaaggagacttacttagtatttwcttatgtctctttgccaatatttgggagtttcacagagcatttctagataatgagggatggaagtgaagagtaggacaaggtattcaaagatctaagaagaatgagaaatcctcgatttcccatatgacaggatgacttggttacacgagtaaaytgctttttgtatgtgaaacaggcagcaattggaggtagcaaagga

SEQ ID NO: 856 - DNA, 401 bp, Homo sapiens
ggtaccatacacatgggaagtgtgaaggagacttacttagtatttwcttatgtctctttgccaatatttgggagtttcacagagcatttctagataatgagggatggaagtgaagagtaggacaaggtattcaaagatctaagaagaatgagaaatcctcgatttcccatatgacaggatgacttggttacacgagtaaaytgctttttgtatgtgaaacaggcagcaattggaggtagcaaaggaatacacaggtaagccctggagtccaattcccaaaattagtggtgttttctgattccctaactgactctatggtaggctcctggtcaaaagatccatcagggctgctgggcccatgctgacattccatatagccatcttctttctgattctctgtc

SEQ ID NO: 857 - DNA, 401 bp, Homo sapiens
ttaaagagttttgttctccggtatcaggagttggccacaaatgctttctctataagttcataattcctgttgggaaacttggaaaagagctctccccttctcatccaaagaagtgatgacttctctttgttagtttacaactaacaaagtcccatttctggtttgaaagtcagatggaccttggcttatatttatttaacraagacgtggaatttctctaacagactgaaagtttattagaataacatctagcattaggcctggcaaataggaggtcctcgttaagagatctgatcagatttgacttctaatcccagatataaggtgtttattctttttgagccactatttcctcatctataaaataagaaatattcataactattccataatatgtattc

SEQ ID NO: 858 - DNA, 401 bp, Homo sapiens
ggattatctaccatgtcttccagcttcaatctctataattgtataaatctggttggcaatggactctttagtgcaaagtcctaaagccttcaagacccaaacttttctcactgggcaagcaatttgcgggaaattaaacaagtccaaaatattgaacaaatgaagaaaggggccattttaacagacaggaatacttcataytgtaaagatggccaggtgtagtggttcacacctgtactcccagcactttgggaagttgaggcaggaggattgcttgaggctaggagtttgagaccagcctgagcaatacagggagacctcatctttgctagaactttaacaattagctgggcatggtggcatgcacctgtagtcccagytatgccagaagagaagggagg

SEQ ID NO: 859 - DNA, 401 bp, Homo sapiens
aacagacaggaatacttcataytgtaaagatggccaggtgtagtggttcacacctgtactcccagcactttgggaagttgaggcaggaggattgcttgaggctaggagtttgagaccagcctgagcaatacagggagacctcatctttgctagaactttaacaattagctgggcatggtggcatgcacctgtagtcccagytatgccagaagagaagggaggattgcttgagcacaggagtttgcaactgcagtgagctatgatcttgcaactgtgctccatcttgggtgacagaatgggaccttgtctcaattttttaaaatatatatatacatatatatatatatakagagagagagagactatatatatgtgtgtgtgtatatatatatatabagaga

SEQ ID NO: 860 - DNA, 401 bp, Homo sapiens
gctagaactttaacaattagctgggcatggtggcatgcacctgtagtcccagytatgccagaagagaagggaggattgcttgagcacaggagtttgcaactgcagtgagctatgatcttgcaactgtgctccatcttgggtgacagaatgggaccttgtctcaattttttaaaatatatatatacatatatatatatatakagagagagagagactatatatatgtgtgtgtgtatatatatatatabagagagagagagacagagagagagtaaagatctcatttcctccacaaatgttaaaaacattattctgattttaaaaaaagaatgaatttttaaaatttacaaatttctgaaatggacaaaaatatcctaggccttcttcctcaaaaaataata

SEQ ID NO: 861 - DNA, 401 bp, Homo sapiens
cccagytatgccagaagagaagggaggattgcttgagcacaggagtttgcaactgcagtgagctatgatcttgcaactgtgctccatcttgggtgacagaatgggaccttgtctcaattttttaaaatatatatatacatatatatatatatakagagagagagagactatatatatgtgtgtgtgtatatatatatatabagagagagagagacagagagagagtaaagatctcatttcctccacaaatgttaaaaacattattctgattttaaaaaaagaatgaatttttaaaatttacaaatttctgaaatggacaaaaatatcctaggccttcttcctcaaaaaataataaataagaataataagaaattgcactggtatctgaaaaagcaacttaa

SEQ ID NO: 862 - DNA, 401 bp, Homo sapiens
atttaaataatttaaaatcttaaaataatgattatatgtataataaaactgtaaatttacaattatagagctataaacaattttatagttgtaatattttgtaactaatgaaacattatattttaatgattttattattgttgtaattaatataaagaagataaagaaaaatgggcaaggtttgaataagcacactttgtygaagatatatggatagccaaaaagcatataaaatatgaccaaaagcctctggtgtttagagaaatgcaaattaaagctaaaatgagattcttctaaatacctatcagaatgtctgagattaaaatgactgactgtagcaactagtggcaggaatgtggaggaactgaagttctcatacactgctggcagaaatgtacgat

SEQ ID NO: 863 - DNA, 401 bp, Homo sapiens
aaaatgactgactgtagcaactagtggcaggaatgtggaggaactgaagttctcatacactgctggcagaaatgtacgatgacacaacccttttgaaaaacattttggcagcttcttaacaatttaaatgtacatatcccatgtaagccagccagtccactcctgggtatttactcaagagaaatgaaagcctatgtccayacaaagacttgtatgtaaatatttataacagctttatctgtaacagctaaaagttggaaaccacccaaatgtctatcagcaggtgagcggataaacaaattgcggcatatacagtgtagatagtggaatactactcagtaataaaaaggaatgaacaattgacacatgctacaacatggatgatgcaaaataattacact

SEQ ID NO: 864 - DNA, 401 bp, Homo sapiens
atttttctctgttattctctactgagaggggatgaggaggattaccaaggggcaaggaggaccttttggaggtgatagatgtgtttattactgggattgtgttgatggcttaccaggtatctatgtaagtcacaactcatcatatggtatactgtaaatatgtgcaggctgggcgtggtggctcatgcctgtaataccagyactctggaaggccgaggtgggagaattaaggccaggagtttgagacatagcaagatcytgtctctagtaaataaataaataaataaataaataaataaataaataaatgcacttttttgtatattgagttatatctcaatgaagctgcttttttttaaaaaaaaaaaaaacatataacataaaagagattaacagaagag

SEQ ID NO: 865 - DNA, 401 bp, Homo sapiens
ggaccttttggaggtgatagatgtgtttattactgggattgtgttgatggcttaccaggtatctatgtaagtcacaactcatcatatggtatactgtaaatatgtgcaggctgggcgtggtggctcatgcctgtaataccagyactctggaaggccgaggtgggagaattaaggccaggagtttgagacatagcaagatcytgtctctagtaaataaataaataaataaataaataaataaataaataaatgcacttttttgtatattgagttatatctcaatgaagctgcttttttttaaaaaaaaaaaaaacatataacataaaagagattaacagaagagattcaaaagtctagaacaccaaatattaaaggtagcttttcaaatcagtgagaaaata

SEQ ID NO: 866 - DNA, 401 bp, Homo sapiens
atgactcagcatagtgttaatggtcttccagatgaaggaggggacatgaacatgtgtctgtcccaataaaggttgagacaaggtttgttgtgcacgtgcgcgtgtgtgtgtgcgtgtgtataacagtgaggagactgtaattagcaggaaaaattggggttttgaaagtagaccacagtcttgtcattgtaccatgactcmccaggaggacagaggacaagtaccctactcctgtgtaaatccagactgccaagtagagcactgagatttgatgagtacttaagaaatgcttgcttgattaattggtaaaagatattaaaggggaagattttatatcacattcaaacatatgaagagaaatgttaaaaatgtttaaagttccatttccagtctcactttcc

SEQ ID NO: 867 - DNA, 401 bp, Homo sapiens
atgtggcagactgccagttgccttccccagcataacattttcccaatattcattaggaaaagaaccctttaattgtacccaattaaaataccgaatctcccagcctcttctgcagcagatgtggctgtgtgactaagttctgtccaataagatataagtatacatgtttggtgagatttccaggaaggatgctcaagtggrgatgactaagtcagaagaaagttccttttagctttcctgcattcctagaattctgatgcaaaagctggagctacagcagcaatcctggactatgaggtaaccttgggagtactagggaattgggatgctagtaactttctagaagcaccaactcagccccagaatgcctcctgctgacttcttttacgtgggagagtaag

SEQ ID NO: 868 - DNA, 401 bp, Homo sapiens
gtccttcactagtatggccttttccaatgtcttgaaaggagtcctagtcacatgttcacatgcttacacatttatgtaaaatatgcaggataagataattaaactacaattatctaagatggcagtctttttttcactctgattttctgtccaaaatattcctcttgtggaagtaggtttggaatggccctgaacattttyggaatctgaactgagagaaagttgagtgaaagatacattgatttaaggcatagtgagatgtctagtaaagttattgtaaggtattccagtgttgaaaaggcttccagaaatatgccaaaaccgactgtgctgactcacatgatgtcatgccagaaagatgaagggccagagattgtatgatgacctgagtttgtccttgt

SEQ ID NO: 869 - DNA, 401 bp, Homo sapiens
ccatactgtaaaactgtcttcgcaaaatctcatcacaagctgaaaagtgatccctggtgataaacaactgagatggttattcacctccatgactagcctttcagggcctcactttctatatccatcaaatgggaagaacaatagatgcctcatcctcctcactatgttgctgtgagcatctgttgaagtagtggctattcragtgcattgaaatgcatcagtcagtacacagatacaagggcttctgataactcatacctgaagaatttttgtcaaccctgaagggatttgcttcttggtatacgggtattaaaatactagtataatttctctaacgggagtatgatgtcactagttccagagtcttttcatagatggatgggttttatgataaataactc

SEQ ID NO: 870 - DNA, 401 bp, Homo sapiens
ttgaaatgcatcagtcagtacacagatacaagggcttctgataactcatacctgaagaatttttgtcaaccctgaagggatttgcttcttggtatacgggtattaaaatactagtataatttctctaacgggagtatgatgtcactagttccagagtcttttcatagatggatgggttttatgataaataactcaccctcrgtgttaacttggctttccaactagccaaacaggcctttgtggaacaaggttagcaaatagcatttgggcaaacgatcaaaagggtctccctctcttctatcactctctttatctctcttggtacctctctctgactttctctccctcctttaaaaagttatctctgttttttttaattttttttacattaaaaacaacaa

SEQ ID NO: 871 - DNA, 401 bp, Homo sapiens
aaaagttatctctgttttttttaattttttttacattaaaaacaacaaatgggcccttcagaatagtcgaaaactttagaatgcaaagatatcaaaaaataagaaataacctagatcagaaaacagataaatgattgccaggggttgggattgggaggagttatttacaaggtgaatgaagaaattatgaggggttgtggracttttctatattttgatcttgaaaattatataactatatacttgtgttaatcttgtagaagtgaacactaaaaagggtgaattttattataaacaattttttaagagaacaaaaaatgtactataatcccaccagccaataacacactattaacactttggcgtacttctgactagtcttttttttttttttttttttt

SEQ ID NO: 872 - DNA, 401 bp, Homo sapiens
tgaataaaatgtactccctttactacttttttttttttttttttttttttttttgagacagggtctcaccctgttgcccaggctagagtgcagtggcgtgatcatggcccactgctgccttgacctccagggctcaagcaatctgcccacatctgcctcctgcctgtgttgctcagactggtcttgaactcctgagctcawgcagtctacctgccttagcttcgtaaagtgctggaattacaggcgagagccaacttgcccagccctgtatttcctttactttgaactgcatttgtgtatccttggttcatgttctatttgatagccatttcttcttaattagagggatttcttttttttagattagaaaaactagcccttttggctatgataagtggttt

SEQ ID NO: 873 - DNA, 401 bp, Homo sapiens
aactgcatttgtgtatccttggttcatgttctatttgatagccatttcttcttaattagagggatttcttttttttagattagaaaaactagcccttttggctatgataagtggtttatatttccttttgtgtgctacttgccttttgtctttatttggcttttttttggacttgcattatttatttaagatttacgtagytggatttctttctcctttcacatatggcctctctcacttcaatattatgtagaaaaaaacctctgaaataatgaattcctatacttttatgggttctttttttattttgatatttgacccatctggaatttattttggtataagaatgaggtagattttcaacaatttattccactaaatcataaattagtacacctttt

SEQ ID NO: 874 - DNA, 401 bp, Homo sapiens
ctttctgtgcctggcttatttcacttaacataatgacatccagttccattcatgttgatgcatataacagatttcattctttttatggctgaatagtaatccattgtatgtatatacacatataacgtctgtatatataatgtgtatataaaatgtatatccataatatatgtatatatacacatatatgtaatatatatwgtgtgtgtgtgtgtgtgtgtgtgtatatatatatatatatatatatatatatatatatatctcacttttttttttgagacagagtcttgctgtgttgcccaggctggagtgcagtggtgcaatctcagctaactgcaacctccacctctcggttcaagggattctcatgcctcagtctcccaaaaagctgggactacagt

SEQ ID NO: 875 - DNA, 401 bp, Homo sapiens
agaaaccaaagattagggaaaatatttttagaacaagctcagggaagtcatataggtttaaaatatatagtctatgcaaataatggcacacatttcagaatggaaacaaaaataagtggcagataatgtgtccaagtaatattggtagcaaatggactgttacgagagcaaatgatattttgcagagctgagagtgtgacytgtcttcaattatttgaatccctatcctacaaaagcattgaaaaaggaagatctggagccaatgactgtgtattacatatattttcattcagtacaagcagacatcatcagtgtgctatatactactttcattattattattatcttaattaaagctgtctyacgagccaggcgcagtggctcacgcctctaatcccaac

SEQ ID NO: 876 - DNA, 401 bp, Homo sapiens
cgagagcaaatgatattttgcagagctgagagtgtgacytgtcttcaattatttgaatccctatcctacaaaagcattgaaaaaggaagatctggagccaatgactgtgtattacatatattttcattcagtacaagcagacatcatcagtgtgctatatactactttcattattattattatcttaattaaagctgtctyacgagccaggcgcagtggctcacgcctctaatcccaacactttgggagaccgaagcaggtggatcacttgaggtcaggagtttgagaccagcctggccaacatggtgaaaccctgtcgctactgaaaatacaaaaattagccaggcatggtggcaggtgcctgtaatcccagctacttgggaggctgagacaggagaatt

SEQ ID NO: 877 - DNA, 401 bp, Homo sapiens
ccctgtcgctactgaaaatacaaaaattagccaggcatggtggcaggtgcctgtaatcccagctacttgggaggctgagacaggagaattgcttgagactgggaagtggatgttgcagtgagccaagatctcactgctgcactccagccaggatgacagagtgagactctgtctcaaaaaaaaaaaaaaaaaaaaaaaaargmcaacawcaacgacaaaactgtctcatgatgaaatgggatgctttcactagccgtggttgctcatgcctgcaatcctagcactttaggaggctgaggcaggtgaatcacctgaggttaggagttcaaggccagcctggccaacatggtgaaaccctgtctctactgaaaatacaaaatttagccgggtgtgctggtgca

SEQ ID NO: 878 - DNA, 401 bp, Homo sapiens
ctgtcgctactgaaaatacaaaaattagccaggcatggtggcaggtgcctgtaatcccagctacttgggaggctgagacaggagaattgcttgagactgggaagtggatgttgcagtgagccaagatctcactgctgcactccagccaggatgacagagtgagactctgtctcaaaaaaaaaaaaaaaaaaaaaaaaargmcaacawcaacgacaaaactgtctcatgatgaaatgggatgctttcactagccgtggttgctcatgcctgcaatcctagcactttaggaggctgaggcaggtgaatcacctgaggttaggagttcaaggccagcctggccaacatggtgaaaccctgtctctactgaaaatacaaaatttagccgggtgtgctggtgcatg

SEQ ID NO: 879 - DNA, 401 bp, Homo sapiens
ctactgaaaatacaaaaattagccaggcatggtggcaggtgcctgtaatcccagctacttgggaggctgagacaggagaattgcttgagactgggaagtggatgttgcagtgagccaagatctcactgctgcactccagccaggatgacagagtgagactctgtctcaaaaaaaaaaaaaaaaaaaaaaaaargmcaacawcaacgacaaaactgtctcatgatgaaatgggatgctttcactagccgtggttgctcatgcctgcaatcctagcactttaggaggctgaggcaggtgaatcacctgaggttaggagttcaaggccagcctggccaacatggtgaaaccctgtctctactgaaaatacaaaatttagccgggtgtgctggtgcatgcctgta

SEQ ID NO: 880 - DNA, 401 bp, Homo sapiens
ctttaggaggctgaggcaggtgaatcacctgaggttaggagttcaaggccagcctggccaacatggtgaaaccctgtctctactgaaaatacaaaatttagccgggtgtgctggtgcatgcctgtaatcccagctactcaggaggctgagacaggagaattgcttgaacccgggaggcagaatttgcagcgagccgagatygtgccactgcactccagcctggacaacagagcagaacactgtctcaaaacaaaacagaacaaaaaaagaaaagggatgctttgtggaacagggagattacttgcactggaattgttcaagccaagttctatcaacatttgacacagaaacacaygaccatcgtaaggtctttcccagctcagcattctgtgactgcgtgg

SEQ ID NO: 881 - DNA, 401 bp, Homo sapiens
gagaattgcttgaacccgggaggcagaatttgcagcgagccgagatygtgccactgcactccagcctggacaacagagcagaacactgtctcaaaacaaaacagaacaaaaaaagaaaagggatgctttgtggaacagggagattacttgcactggaattgttcaagccaagttctatcaacatttgacacagaaacacaygaccatcgtaaggtctttcccagctcagcattctgtgactgcgtggtctttgtactgagttttacatgatatggatttcttaccttagaaggatcagtttttaaaagatgggctgaatgaatcaaatcagagaacactatttgcctacccaatatctagtctccacagctagctggggacactttatagccacgttaaaa

SEQ ID NO: 882 - DNA, 401 bp, Homo sapiens
ccttaagaagggagacagaggatgctaacatggaacttgtcctttgccttcccattctcctttctgccatctggatcaggatatctggccatgctgaaatcatgagacaacatgaaggataaaatcctcaaactaagaatagaaatcagaacattaggacctggtctgagttcattgtggagcttccccagcccgctcagkctgcccccagtcttcccatttttagaaaaattaaaactatggtttgttaaagcttctattctgatggtctctgttacttgtagctgaacgcaatgaattgtgagatacgatttaccacaatttttttctttctttctttcttttttcttcttcttcattttttttttttttttwttttttaaagggttgtgccatgtcac

SEQ ID NO: 883 - DNA, 401 bp, Homo sapiens
ttgtggagcttccccagcccgctcagkctgcccccagtcttcccatttttagaaaaattaaaactatggtttgttaaagcttctattctgatggtctctgttacttgtagctgaacgcaatgaattgtgagatacgatttaccacaatttttttctttctttctttcttttttcttcttcttcattttttttttttttttwttttttaaagggttgtgccatgtcacccaggctggagtgcaattgtgcgatcatgactgactgtggtgtcaacctcccaggctcaagcaatcctcccacctcagtctcctaagtagctgtgactataggcatgtgccaccatgccaggctaatttttgtattttttgtagagatggggtcttgctgtgttgcacaggctg

SEQ ID NO: 884 - DNA, 401 bp, Homo sapiens
cctgggaggttgaggttgcagtgagccaagattgcaccactgcactccagcctgggtgacagagcgagatcctgtctcaaaaaaattaaataaatcaatatatggtaatctaatgggatgctatgcagcactaaaagtatattttaaaaaaaacttgagaaatgcttctaagatgaataatacacaattaagtcaattacmtgacttcaaatattattataactgcatgtggacaagaagacaaaaccttcaaggaaaaaaagttttgatattatgagattatgggtaacattgtattcccagccttgaatttctgttattgttactataatatgtgtacaatttttttttagtgaagtaaaacaaacaagtaaaagaaaggttgaaacttcacaatgtag

SEQ ID NO: 885 - DNA, 401 bp, Homo sapiens
tagctgggactacaggcacacaccaccacacctggatatagttttttttttagagatgaggccttctacattgcccagtttggtctcaaattcctgagatcaagcaatccccccaccttggctcctcaaagtgctgggattacaggtgcgagccaccgtgcccagcctcatcagcatttttagacagctacccctctgtgrtactctgtggtgagaaataagtttaagagataagtatgcagttatgaggaaagrtgatagaaccacaccatttttatgaataatatactaaaatatattcttaaaaaacttgtcagttgtatatttgataatagcatatttttacttagtccttattaaagatctcgggaaattcaaatctgtttcatctttgatcagga

SEQ ID NO: 886 - DNA, 401 bp, Homo sapiens
gatgaggccttctacattgcccagtttggtctcaaattcctgagatcaagcaatccccccaccttggctcctcaaagtgctgggattacaggtgcgagccaccgtgcccagcctcatcagcatttttagacagctacccctctgtgrtactctgtggtgagaaataagtttaagagataagtatgcagttatgaggaaagrtgatagaaccacaccatttttatgaataatatactaaaatatattcttaaaaaacttgtcagttgtatatttgataatagcatatttttacttagtccttattaaagatctcgggaaattcaaatctgtttcatctttgatcaggagagaagatgttgcccatccttagcccagagttagaaaggagaaatcatgtgatt

SEQ ID NO: 887 - DNA, 401 bp, Homo sapiens
ctggaaaaatcttctaaaactcttccttctcaagaagtcctgcaactggagctactaatgaaagctctttccagtagcccttacagctaattttctgttcacatatttgtcttctgctgtaaagagctgtgcctcatagtgtattaagggctggcttttcctttcattgtaagggactttccaccacaaacacaaggccaycatggccagcaatgcacaaaacagcagagtatggtcggcccttaaagacaaggtttgacttactcctctcttctcttttttacagacatgtttctctactataaacttcactcttagctttattttcaagaataaaatatttctgttttcaaattggcatcttacgattcagcagactaacccaagaaataattttatgg

SEQ ID NO: 888 - DNA, 401 bp, Homo sapiens
aatgcacaaaacagcagagtatggtcggcccttaaagacaaggtttgacttactcctctcttctcttttttacagacatgtttctctactataaacttcactcttagctttattttcaagaataaaatatttctgttttcaaattggcatcttacgattcagcagactaacccaagaaataattttatggaataatcatawttcaatatcttatttcttttcaaaggaacatttaaaagcttataaaactaggtataacaatgaagctgtaaaagaaagtaagaaaacacaatcaaagttaaaatgaaccaagctaaaaggtaaatataattattggtgttaggctccatatttgcctacaggcttcctaatattcagagcaaaatggaaaacaaactgtt

SEQ ID NO: 889 - DNA, 401 bp, Homo sapiens
aatcaatgtgccccatcttctacccttctgcataggacccccattcccttgacatggtgattttccagaggatgggtacctaggtacctggccaataagagttcgagatcaataagagtcttcccagaggttaatacatatgctttggaatggagtttattgcccactaaagatgctaagctggaaaaatataaattgggrctatccattggctaaattccctgccctgaggagcaggcctgtctccagtgggaggaagaaaactgaacagaggagaattgcaaatggagagagagcaagccctgtgtactgagttctggcttctgtccctgaggccctgaaacctggctgctgcagcttttgattctgaccatgatccaagagtccttccaagcagtgag

SEQ ID NO: 890 - DNA, 401 bp, Homo sapiens
ataaaccttgaataaaagccaagggcataacattaaagcaaaattgagttaaagccattttggaagaattagcccagtgcacatagagtgttcaacatttgagtggctcaattcacccaagaaagcttcaagaagttgaaggacactttttaactttgacagctttcttcatgtgttcctttgtttccccatttacccaarcttctgataaaggttgaataacaagtattttgagattctaattttcaaccagagctaacattttccactactaagtgagaaagggatctaaatgcttcagagactgggggaaattagaggagagcaaagttatgctacttgtatctraatataagaccacttgtctctgcacagaattgacccctgtgggacctttgggg

SEQ ID NO: 891 - DNA, 401 bp, Homo sapiens
ttttaactttgacagctttcttcatgtgttcctttgtttccccatttacccaarcttctgataaaggttgaataacaagtattttgagattctaattttcaaccagagctaacattttccactactaagtgagaaagggatctaaatgcttcagagactgggggaaattagaggagagcaaagttatgctacttgtatctraatataagaccacttgtctctgcacagaattgacccctgtgggacctttggggatacctgcaagatatgcaggctgtttttttctatcaataaacyttggattttcaacaacacaaaaacacatcatcaattagatccccagagtcatgaaccaaaacagttttcacatgaaatttattcaaagtaaggatttgtagtta

SEQ ID NO: 892 - DNA, 401 bp, Homo sapiens
tttcaaccagagctaacattttccactactaagtgagaaagggatctaaatgcttcagagactgggggaaattagaggagagcaaagttatgctacttgtatctraatataagaccacttgtctctgcacagaattgacccctgtgggacctttggggatacctgcaagatatgcaggctgtttttttctatcaataaacyttggattttcaacaacacaaaaacacatcatcaattagatccccagagtcatgaaccaaaacagttttcacatgaaatttattcaaagtaaggatttgtagttacctgttgtgatatgggaaaaccacacagcagcttggcttccagtgtgctttccagagtgaattagttttaaagtgtttattttctttattccctcc

SEQ ID NO: 893 - DNA, 401 bp, Homo sapiens
gataagggagaaagaaggaacaaggccagctagacatgttgtggggcccagtgggaaatgaaaatgctgagtctctcattaaaaaatcattaggaatttcaagagggtaatagtagagcaccaaactgtgcattgtacaggacttttactcataaagccagctctaagaataaaacatcctatattcattatgcccggggygcttccatttactcactgagtgcctaccatgacagccactgtggtaggtacttaattctacctaaaagcaataatacaggattaggatagaagcccaaatgaagaagaaaccaaacatagctccaatttatagcacctaagagcattttcacctgtaaggaattttttctatttttacaggaaaratcaagggatttgcc

SEQ ID NO: 894 - DNA, 401 bp, Homo sapiens
tcattatgcccggggygcttccatttactcactgagtgcctaccatgacagccactgtggtaggtacttaattctacctaaaagcaataatacaggattaggatagaagcccaaatgaagaagaaaccaaacatagctccaatttatagcacctaagagcattttcacctgtaaggaattttttctatttttacaggaaaratcaagggatttgccctgattcttggagtacttaagtgcaaattttgaagcatttcaattgttgaaaacatatctttttttwatatactttaagttttagggtacatgtgcacaacgtgcaggttagttacatatttatacatgtgccatgttggtgtgcttcacccagtaactcgtcatttaatattaggtatatctcc

SEQ ID NO: 895 - DNA, 401 bp, Homo sapiens
agcaataatacaggattaggatagaagcccaaatgaagaagaaaccaaacatagctccaatttatagcacctaagagcattttcacctgtaaggaattttttctatttttacaggaaaratcaagggatttgccctgattcttggagtacttaagtgcaaattttgaagcatttcaattgttgaaaacatatctttttttwatatactttaagttttagggtacatgtgcacaacgtgcaggttagttacatatttatacatgtgccatgttggtgtgcttcacccagtaactcgtcatttaatattaggtatatctccaaatgctatccctcccccstcccccaaccccacaacaggccccagagtgtgttgttccccttcctgtatccatgtgttctca

SEQ ID NO: 896 - DNA, 401 bp, Homo sapiens
attcttggagtacttaagtgcaaattttgaagcatttcaattgttgaaaacatatctttttttwatatactttaagttttagggtacatgtgcacaacgtgcaggttagttacatatttatacatgtgccatgttggtgtgcttcacccagtaactcgtcatttaatattaggtatatctccaaatgctatccctcccccstcccccaaccccacaacaggccccagagtgtgttgttccccttcctgtatccatgtgttctcattgttcaattcccacctatgagtgagaaaatgcggtgtttggctttttgtccttgtgatagtttgctgagaatgatggtttccagtttcatccatgtccctacaaaggacatgaactcatcattttttttggctgca

SEQ ID NO: 897 - DNA, 401 bp, Homo sapiens
acaacaggccccagagtgtgttgttccccttcctgtatccatgtgttctcattgttcaattcccacctatgagtgagaaaatgcggtgtttggctttttgtccttgtgatagtttgctgagaatgatggtttccagtttcatccatgtccctacaaaggacatgaactcatcattttttttggctgcatagtattccatgrtgtatatgtgccacattttcttaatccggtctatcattgttggacatttgggttggttccaagtctttgctattgtgaatagtgccgcaataaacatatcttttttttaaaacttagcatatatctatttgccatctcctgggtcaaaaagccaatggaaagctcaatgaaatctccaaatattcttaggttcaccttga

SEQ ID NO: 898 - DNA, 401 bp, Homo sapiens
tggtgcctccaaggtaactgtttcctctacctggaacactcttcccttgatccttgcatgatttgctttgtcttgtcattccatgaaaataacttttactctgaaaagccttagccaagcccctaaagtagccccacagtcacatccactctcctgagcacttgttaccatctgattatgtttgttggcttgttcgtttgytgactgtttggaatataagcttcacgagggcagctgtgtaccctgttcaatgggacatcctcaacacggaggcagggcctggtacagcacagtcctcaataaatacttgataacaaaataaataatttatgttgcattttggaataataattatattcttagttacacattagctgtatctagaagactgataatactgg

SEQ ID NO: 899 - DNA, 401 bp, Homo sapiens
gttaaaactgaaagtaaatatagacaaaataattgaacatatttgacaaaatatagacatctaaaagtgaaaagcattttaaaagtgagaaaactcctagagagtttgaactattatatggtattttcacctttagattatgaatagcatgaatgagatgataacaatggtaataacaataaattcactataagttcttakaatttagaagataccattctagaagctttccatgaattatctcattaactattactgcagtcttatgaagtgagtattatgatcatttctaatcttatgcatgacaattgagatttaaagagtataactttccaaggtgacaaatttagcaggtgtcagaatccagttctgtcagaagaaataagtagaaaataaaggtg

SEQ ID NO: 900 - DNA, 401 bp, Homo sapiens
ttatgaagtgagtattatgatcatttctaatcttatgcatgacaattgagatttaaagagtataactttccaaggtgacaaatttagcaggtgtcagaatccagttctgtcagaagaaataagtagaaaataaaggtgggtttgttggcgactagataatcataataaacattgatataatcgtttataatttttcataamcgtagaaattatacaacctgtgtaaagccaaaatactttggtgatttctgggttcagaagataatgccttttgtagctatggagcttagatcttgtagctatatgtgtttgactgagggaagtggaaattctctaactgggatatcataccaggatgatgaattacctgtgcaaactctcactattgcaaggtcctatct

SEQ ID NO: 901 - DNA, 401 bp, Homo sapiens
cagacaccatctggtgatggattggtccgtcatgcggtatcagtctgcagaatcatcttcagtactttaaggacagtgcagactagaggaaagattccaggttagatgtcagctatttgccaattagatgacctgggtatgtaatgagaatgcatagccccacttcgtctggtaaattgggactgtaattcttactttgtyttagcccacaggatgatatgtatagaaagtgagttataaactgtaaatgaagctgggcacagtggctcacacttgtaatcccagcattttgggaggccaaggagggaggatcacttgagcccaggagtttaagatcagactaggcaacatagggagaacttgtctctagaataaaatagaaaaacatagccaggagtggt

SEQ ID NO: 902 - DNA, 401 bp, Homo sapiens
aaaacatagccaggagtggtggtatgtacctatagtctcagcaacttgggaagctgagctgggaagatagcttgaggggaggagttcaaggctgcagtgagttgtgattgcaccactacactccagcccgggtgacagagcaagaccctgtctcaaaagacaataatattataaataaataaataaacaaactgtaaatgrtacaaatataaaagagcaatactaacgacaaataataatacatataatgaatgcattgataatgacagtgaaagttagaagtgattcttttagcacagagataagagattagctcatggctcaggccaggcctcacagattatctgtctcctggtgggactaatgcaagatctgaagtttggtctgtaactttgtcattt

SEQ ID NO: 903 - DNA, 401 bp, Homo sapiens
agtgattcttttagcacagagataagagattagctcatggctcaggccaggcctcacagattatctgtctcctggtgggactaatgcaagatctgaagtttggtctgtaactttgtcattttggtttgttctatggaccaaactctggagtactgattaacatcattgtctagcagttgaaagctctctgataaccttggrgagtgctagatagaatagatacaattttgccttttgattttcctttgcccaaacaagtggttcacatatgaagatgtcttttggaagggaaaaataaaaattacagattcccatgtaatagggaaactgagtcttaaaatccaacaccaccatcttatttctaagtcgtttttacattagggcttgttataaacctaggt

SEQ ID NO: 904 - DNA, 401 bp, Homo sapiens
tgtcttttggaagggaaaaataaaaattacagattcccatgtaatagggaaactgagtcttaaaatccaacaccaccatcttatttctaagtcgtttttacattagggcttgttataaacctaggttattttgttttgcctacgtgtaaatcttgatggattcaaaaattccccaagtaacttagtgagatttcaaaaagrtccttgattttagcagcgtttttataaaactgtcagttacagtagataacaatagcaattctattctcctccattttaaactggaatttactgattcaaatttttaagagaaaaagttcctgaacttgtccccttattctaggggaaaccattttggtgcctgtctatagctacttatggcctctctctcttgttttttg

SEQ ID NO: 905 - DNA, 401 bp, Homo sapiens
tcaccgtcacaacagtaccaagggggatggtgttaaaccagtcaagagaaaccacccctatgatccatcacctcccaccaggccccatcttcaacactgggaattacaatagaacatgggatttcggtggggacacagatccaagccatatcacctagtaatcatcctcaccttcagttaaagcagcctgtgtgtttactrawgaaattagctacttgacaccaatcttttcagcaatactgctgtcagataagagaatcattgagtaaaatgccattaattgcaaataataaaacgtcattcattcaaatcacgtaatgagaagtttgaattctgtctccaaaaccaacccttacttttgtttatttatttttacctagtacccagggcatgattctgtc

SEQ ID NO: 906 - DNA, 401 bp, Homo sapiens
accgtcacaacagtaccaagggggatggtgttaaaccagtcaagagaaaccacccctatgatccatcacctcccaccaggccccatcttcaacactgggaattacaatagaacatgggatttcggtggggacacagatccaagccatatcacctagtaatcatcctcaccttcagttaaagcagcctgtgtgtttactrawgaaattagctacttgacaccaatcttttcagcaatactgctgtcagataagagaatcattgagtaaaatgccattaattgcaaataataaaacgtcattcattcaaatcacgtaatgagaagtttgaattctgtctccaaaaccaacccttacttttgtttatttatttttacctagtacccagggcatgattctgtcta

SEQ ID NO: 907 - DNA, 401 bp, Homo sapiens
tttagagacagagtctcactctgttgctcaggctggaatgccgtggtgcagtcatggctcactgcagcctcaaactactggcctcaagcaatcctcctgcctcagcctcccaaatctgtggaactgcatgcatgtgccaccacatctggccctggaatatgattttataagaaagctgtctctctattaaagttttatgcraagaggaaaactaaatcagtggacagagctaagagttagacracccagactttcctccctccgttgcctctgtttctgtctttgcaaaataaggaaatttgactagcttatctttaaaacctctacttgctcattctatgatggtgccttgagatggagattcagtgagagattcttgtttcagtgcttttatatattta

SEQ ID NO: 908 - DNA, 401 bp, Homo sapiens
gtggtgcagtcatggctcactgcagcctcaaactactggcctcaagcaatcctcctgcctcagcctcccaaatctgtggaactgcatgcatgtgccaccacatctggccctggaatatgattttataagaaagctgtctctctattaaagttttatgcraagaggaaaactaaatcagtggacagagctaagagttagacracccagactttcctccctccgttgcctctgtttctgtctttgcaaaataaggaaatttgactagcttatctttaaaacctctacttgctcattctatgatggtgccttgagatggagattcagtgagagattcttgtttcagtgcttttatatatttaacaaattttcaccgagtacctattacgtgtcaggacctgctc

SEQ ID NO: 909 - DNA, 401 bp, Homo sapiens
ctctccttactttcatttcttgacctactcctagacccatgcagataccaaattttacaaattttactaccagcaaatagttatctattatgcagttaaactgtgctatgtgtagggatgcagagcaaatcaagacatagcatatgccttcaagaagccaatgatgtccttgtgagaacaaaactcacatatgtaaaaaawaattgctagttcaaaatgtcagaggctgagaaccaggaatatggcctgaacagttgtgtgctctatcaggagagattcactaaaagttagtagacttcaggaataattttcagtgcacataaagcttgaacttaagtaacataggtagttttcagattttaaaagcaattttcagtaaatacaagtagagatatggcctg

SEQ ID NO: 910 - DNA, 401 bp, Homo sapiens
ctgtgtacactgagataaaagtagagtgggagactgagtttaccacctgtgctaaagcagcagctgttagcattggtgacattcattgttacatggatatcaattgagctgggattaggaagccgcctgtctcctcaagcttgttacgattcagtcacttggaaaaaaacaaaaacagactttcggatgaggattctaatkcccaggtgacctgaaagccaggttcagcgtagtcaatgagcaacatgaaatgaaatttccaatcagaattctcattagccttattcagcactacccagatggatgttccttttgatgtctttgtcatagcagcctcacctatgcaaatattgccagtattaccccttatagtaagttgaagaacttttaagggttgtgaa

SEQ ID NO: 911 - DNA, 401 bp, Homo sapiens
tagtcattgttgaaatccgtaatctctttctatcgccaaattgtcttaaaacgtctgtccagcacatcattgcaaccttgactgtcccttccactgtgtgttgaagagtcacaggtcccagggggagctgcgaagaaacgtaaaccaaataccatttcagtaactgttaagggacaattgtgacgattttgtaatgcttgrcatgttttgcttataatcttgtcctacaaagaagcctatcagcagagatgagagatttttgctatgcaaagattagattaatattgatatttgcagaactgggttcaacctgtgggagacctagtcgcaggtcttgtagaatttatagcatattaagaagatatttaaatatttggcttcagtgtgatggcctcatttct

SEQ ID NO: 912 - DNA, 401 bp, Homo sapiens
gtccgctgaaagatgagtcatcaagtctggttgaacctatctaatatctcttgaatcagtatgtctctgcatctgtattgccatcaccctagttctggccatcctcactgaccacctgactttctgcctaaatggtctcctactttctggtcttgtatactttcaaccctttctctgcaatcagagtgatattgcttccartgttgtacagacaattcttacaaggtcctgcagcttttctttcagtctttctttcttttttttttttttwttttgaaatggagtctcactctgtcacccaggttggagtgcagtgggcgcgatctcagctcactgcaacctctgcctcccaggtttaaacgattttcgttcctcagccttccaataactggggttacagg

SEQ ID NO: 913 - DNA, 401 bp, Homo sapiens
atctgtattgccatcaccctagttctggccatcctcactgaccacctgactttctgcctaaatggtctcctactttctggtcttgtatactttcaaccctttctctgcaatcagagtgatattgcttccartgttgtacagacaattcttacaaggtcctgcagcttttctttcagtctttctttcttttttttttttttwttttgaaatggagtctcactctgtcacccaggttggagtgcagtgggcgcgatctcagctcactgcaacctctgcctcccaggtttaaacgattttcgttcctcagccttccaataactggggttacaggtgcatgccaccatgcccagccaatttttgtatttttagtagaaagagggtttcaccatgttggccaaact

SEQ ID NO: 914 - DNA, 401 bp, Homo sapiens
gtgctgggattacaggcgtgagccactacacccagctctttcagtcttactgttcgtcatttttttccctcccctttctgcaccctcttcactctgctttcccattctctatgcctgggctacatcttaaaagacgccatgttctcctggggtctctggtgtccctgattctggaaatgctttcctgtctcttctctctamcccatttcacttagataagtcctatttatccttgagatttctcataggtggcagtctttttcccataagacttttcctgttctagacctggtggctcacacctgtgatcctagcactttgggaggcacagccagggcgaatgaacccaggtgtttgataccaacctgggcaacatagtgagactccatctctacaaaaaa

SEQ ID NO: 915 - DNA, 401 bp, Homo sapiens
gataagtcctatttatccttgagatttctcataggtggcagtctttttcccataagacttttcctgttctagacctggtggctcacacctgtgatcctagcactttgggaggcacagccagggcgaatgaacccaggtgtttgataccaacctgggcaacatagtgagactccatctctacaaaaaataaacaaccaggcrtggtgatgagcacctgtagtccaggcatggtggtgagcacctttagtcccagctactcaggagsctgaggtgggaggattgcttgagcctgggaggtcaagacttcagtgagccgtgatcatgccactgcattccagcctgggcaacagagcgagaccctgtcttaaaaaaaaaaaaaaaaagaagaagaagaagaaaag

SEQ ID NO: 916 - DNA, 401 bp, Homo sapiens
tgttctagacctggtggctcacacctgtgatcctagcactttgggaggcacagccagggcgaatgaacccaggtgtttgataccaacctgggcaacatagtgagactccatctctacaaaaaataaacaaccaggcrtggtgatgagcacctgtagtccaggcatggtggtgagcacctttagtcccagctactcaggagsctgaggtgggaggattgcttgagcctgggaggtcaagacttcagtgagccgtgatcatgccactgcattccagcctgggcaacagagcgagaccctgtcttaaaaaaaaaaaaaaaaagaagaagaagaagaaaagaaaaactttccctgatatatttaggttgagactagacaccctcttatctgctcccacaatgccc

SEQ ID NO: 917 - DNA, 401 bp, Homo sapiens
atgtgtgtgtgtgtccttttttggggggaggggggctggtggcaggacagggtctcactttgttgcccaggctggagtgcagtggcaggatcatggctcactgcagcctctacctcctgggctcaagtaatcctcccacctcagcctccctaatagctgggattacaggcatgcaccaccatgctcaggtagggttttttwaatttttcatagagacaggttcttgtcatgttgcccagtctggaatatatatatttttttgacttttattttaggttcagtgatacaagtgctggtttgttatatagataaactcatgtcacggggatctgttgtgcagattgttttgtcactcaggtactaagcccagtacccaatacttactttttcttttcctctct

SEQ ID NO: 918 - DNA, 401 bp, Homo sapiens
acatttacaagcaaatgtaaacttttaaggattcttacatcccataaaagcagtaattttggcatatagctcatcaacatgaaatgagtaaaaacatgggaaggcagtactttttgaatgttgtatgccatttggcaaatctacatgttcctcccttttttcgcatctccatgttcctcctaaatgaaggagttgttgttratgttggtttactttaatatgtccaattataccattatcatctatttatcaaaatagtgccatttaattgccttttgctttaagctgtattttatatgaaagattcctagtgttatttctgtcctttggaatattatccagcagagggaattttaggatctacttgataatacagatttgctaatttccacgttagtact

SEQ ID NO: 919 - DNA, 401 bp, Homo sapiens
acaaacctgcacatgtacccatgaacctaaaataaaagtttaaataaataaataaacttggtctccagtgttaaatatgatatgtcatcatcctcatttccttcatccagctattttatattcctcccatctgctctgtcctaatatttatattctgtaggccttatcgtgcatctcttattccttctaaatatgttttaytctgcctggttcctccactcttttggctcttgttttcctacttcctttaatgtaacagtaacacagtgagcacttaatagcagtctagaataaactctgtgttcctgctttaatctatatctggtctttatctctcacctttatctttacctctgtcactgtgtggacttacactgaaaacagaactataccatgccccc

SEQ ID NO: 920 - DNA, 401 bp, Homo sapiens
atccttcacagcaacctacaaagtcaatctggggctggtggaaattctcctctttcagccttttccttcttttggaatttgggggtgttttcacagagtgatttaccaagaaaacattctaaatcctcaaggatcacttatcccttacctcgtggttgtttgctcgagaccaagcacaactggacatttttgaacttacgwctttctccctaccctctttgttctccttctcccccttcataaaatctgacttcagtttggccttcaagtgagattgacttttagccccttccatttggcaaatccttcaacaaaaaaacagaagtgtcatttttacggggtgacaaagcattaagaagatcgctttttcagccttgctgtgcttcattataggtaagtcc

SEQ ID NO: 921 - DNA, 401 bp, Homo sapiens
ctctcagcaaaagagaacgcaaggaatgcatatttcatctcatggcgacctgaggatcgtcctcaattccatatgtaatactttctaaataatggtgacctttttcacgtccccttcctgtatatacaaagtactatgtggataatgcagcctgagtgagcttatgagctaatgcagggatttttattattaacaataatmatagtgaacaacagtttattcatgtaagatcaagcaactagtaagtggtagaaccaggactgggtcatagggtaggtacatgtgtaccacttttaaatattgccaaactactttgcaaagtattgaattattttacattcccaacagcagtgtctgggaattacaataatccttatcatgcaatgactggcgtattcatt

SEQ ID NO: 922 - DNA, 401 bp, Homo sapiens
ccaggactgggtcatagggtaggtacatgtgtaccacttttaaatattgccaaactactttgcaaagtattgaattattttacattcccaacagcagtgtctgggaattacaataatccttatcatgcaatgactggcgtattcattctttttaatttttgacattctaatctgtgtgtagtgccatctcattgtagtttkaatttgcatttcgctagtgactaatgatattgagcatcttttcatgagcttatttgcatatgtatgtcttctttgctaaagtgtctatgcaaatcttttgcccatttattaggttgtttgttttcttatattgagttataactttttttttttttacatattctgcaaacatttttaaccagatatgtagtttacaagtg

SEQ ID NO: 923 - DNA, 401 bp, Homo sapiens
tatatattttgtcagagttcgcccaaatggtacatttatttatctatttatttagagatggagttttgttcttgttgcccaggctggaatgcaatagcacaatctcagctcactgcaacctccacctcccaggctgaagcgattctcctgcctcagcctcccaagtagctgggattacaggtgccagccaccacacccggytcattttgtatttttaatagcaatggggtttcactatgttggttaggctagtgttgaactcctgacctcaggtggtccacctccctcggcctcccaaagtactgggattacaggcatgagccactgtgcctggcccaaatagtacatatttttgatgctattattaatgacattgttttattaatttatatttcaagttg

SEQ ID NO: 924 - DNA, 401 bp, Homo sapiens
caggtggtccacctccctcggcctcccaaagtactgggattacaggcatgagccactgtgcctggcccaaatagtacatatttttgatgctattattaatgacattgttttattaatttatatttcaagttgtttatttctattacagagctttctctactatgctgacatccatctgaggtctcttctcaacagaattgmctttaatgtccacatttctaccaagcttctcttcaaggaaatctatattttttctattactcaccttaaaattcttgtagcctctatccatttcccaattccgaagccatttctacatctttaggtgtttgttagaggagtaccccactttctcgcatcaaagtctgtatcagtcagtgtttgacagagaacagaaccaa

SEQ ID NO: 925 - DNA, 401 bp, Homo sapiens
actcaccttaaaattcttgtagcctctatccatttcccaattccgaagccatttctacatctttaggtgtttgttagaggagtaccccactttctcgcatcaaagtctgtatcagtcagtgtttgacagagaacagaaccaataggagatggataaataggtaggtaggcagattagtaggtagatagatagataggtagrtagatacatagatagataatctatagatatctaatgcctggaaagctaatttttctatatattttctctattattttagttgtttcagatagaaggacaaattggatccctgttactctatcttgaccagagtgaaaatctgattaacttttaatcctcagtctcctcatttgtaaaaygaaaataataataaaatctat

SEQ ID NO: 926 - DNA, 401 bp, Homo sapiens
ggtagatagatagataggtagrtagatacatagatagataatctatagatatctaatgcctggaaagctaatttttctatatattttctctattattttagttgtttcagatagaaggacaaattggatccctgttactctatcttgaccagagtgaaaatctgattaacttttaatcctcagtctcctcatttgtaaaaygaaaataataataaaatctatttcatgaggttattgggatgttagttttgttaatatgtataaaaacttggtgccttgtacataataaatactcaataaatgtatttaaattttgaacaacatatttgacatattgtgattwmcaagtatctatactcttttatgtttgttaatgttatatatggaggcaatctgactta

SEQ ID NO: 927 - DNA, 401 bp, Homo sapiens
tcttgaccagagtgaaaatctgattaacttttaatcctcagtctcctcatttgtaaaaygaaaataataataaaatctatttcatgaggttattgggatgttagttttgttaatatgtataaaaacttggtgccttgtacataataaatactcaataaatgtatttaaattttgaacaacatatttgacatattgtgattwmcaagtatctatactcttttatgtttgttaatgttatatatggaggcaatctgacttaacatcaaaaaaaaaaaaaagaccattcataagatgtagtcagtaccagtaaatgagagcacattttcctctaattgggtgtgtggatattggttttcaccctacttggagtttctgactatttgtcctagtgaccatcacta

SEQ ID NO: 928 - DNA, 401 bp, Homo sapiens
cttgaccagagtgaaaatctgattaacttttaatcctcagtctcctcatttgtaaaaygaaaataataataaaatctatttcatgaggttattgggatgttagttttgttaatatgtataaaaacttggtgccttgtacataataaatactcaataaatgtatttaaattttgaacaacatatttgacatattgtgattwmcaagtatctatactcttttatgtttgttaatgttatatatggaggcaatctgacttaacatcaaaaaaaaaaaaaagaccattcataagatgtagtcagtaccagtaaatgagagcacattttcctctaattgggtgtgtggatattggttttcaccctacttggagtttctgactatttgtcctagtgaccatcactat

SEQ ID NO: 929 - DNA, 401 bp, Homo sapiens
gcgttaataaggaaatgctggatagtcagaatcctacattaacccgagcctaaaatctgtagtatcgcttcaaatatctatgtagaaagcatagtttattaaactaaacatctcctgtaatcccagcactttgggaggccaatgtgggtgaatcacttgaggtcaggagtttgagaccagcctggccaacgtggcaaactmtgtctctaccaaaaatacaaaaattagccaggtgtggtggtgcaaccctatagtctgagctacttgggaggctgatcacttaatttaaaacttaaaagacctaatatccagaatctataaggcacttaaacagattcacaagcaacaaacaaacccattacaaactgggcaaacgacacgaacagacacttttcaagaga

SEQ ID NO: 930 - DNA, 401 bp, Homo sapiens
gtcattcgatgaaataggctgaatttagctaaaagggagttcatgtcctttgaagaaacatggatggagctggaggccattatccttagcaaatgaacacaggaacagaaaacaaaataccacatgccctcacttatcagtgggagctaaacaaagaaaacacatggacacaaagagaagaacaacagacactggggtctrctgagggcagaaggtgggaggagggagaagatcagaaaaactacctatcaggtactatgcttcatacctgggttacaaaataatctgtacgtcaaatgcctgtgacacaagggtacctgtataacaaacctgcatatgtacccctgaacctaaaataaaagttgtttgtttggtttttttgtttgtttgtttgttttgag

SEQ ID NO: 931 - DNA, 401 bp, Homo sapiens
ggttacaaaataatctgtacgtcaaatgcctgtgacacaagggtacctgtataacaaacctgcatatgtacccctgaacctaaaataaaagttgtttgtttggtttttttgtttgtttgtttgttttgagacagagtcttgttcttgttgcccaggctggagtgcagtggcgcgatcttggttcactgcaacctctgcctycttggttcaagcaattctccctgcctcagtcacccgagtacctgggacaacaggcgcctaccacaacgccaggctaatttttgtattttttagtacagatggggttttgccatgttggccaggcttgtctcraactcctaacctgaggtgatctgcccacctcggcctcccgaagtgctgggattacagttgtgagccac

SEQ ID NO: 932 - DNA, 401 bp, Homo sapiens
agagtcttgttcttgttgcccaggctggagtgcagtggcgcgatcttggttcactgcaacctctgcctycttggttcaagcaattctccctgcctcagtcacccgagtacctgggacaacaggcgcctaccacaacgccaggctaatttttgtattttttagtacagatggggttttgccatgttggccaggcttgtctcraactcctaacctgaggtgatctgcccacctcggcctcccgaagtgctgggattacagttgtgagccaccacgcctggcctaaaagtttttttaaaaagagaaaacactttccttaccctttgtagctcattgtctatctaacacaccctgtcactctcatcagccttgaacttcttacaaagccattcaataaaatgaaa

SEQ ID NO: 933 - DNA, 401 bp, Homo sapiens
tgtctatctaacacaccctgtcactctcatcagccttgaacttcttacaaagccattcaataaaatgaaaggaaataggtgcagtgggccccctctgattcgtggctttgatttctttggtttcatttatccacagtctaaaaatattaaatggaaaatttaaaaaaaaaacaattcataagtgttaaattgcatgccatkctgagtagcgtgatgaaatcttgccctgtyccactctgtcccatgcgggacatgaattcttcccctttgtccagcagttcctcactgtctatgcctccgacctgttagtcactcagtagccctctcagttattagatcgaccatggcagtatgggggtgcttgtgttgaagtcacccttattttacttcctaatggcctc

SEQ ID NO: 934 - DNA, 401 bp, Homo sapiens
cagccttgaacttcttacaaagccattcaataaaatgaaaggaaataggtgcagtgggccccctctgattcgtggctttgatttctttggtttcatttatccacagtctaaaaatattaaatggaaaatttaaaaaaaaaacaattcataagtgttaaattgcatgccatkctgagtagcgtgatgaaatcttgccctgtyccactctgtcccatgcgggacatgaattcttcccctttgtccagcagttcctcactgtctatgcctccgacctgttagtcactcagtagccctctcagttattagatcgaccatggcagtatgggggtgcttgtgttgaagtcacccttattttacttcctaatggcctcaaagcacaggagtagcaatgctggagattt

SEQ ID NO: 935 - DNA, 401 bp, Homo sapiens
gaccagcctgggcaagatggtgaaacgccgtctctactaaaaatataaaaattagccaggcacagtggcaggtgcctgtaatcgcagctacttgggaagctgaggcagagaattgcttgaacctggaaggcagaaaagttgcagtgagccgagatcatgccactgcactccagcctgggcgacagagcgacactctgtctyaaaaaaaaaaaaaaaaaaaagaaagaaaaaagaaatgagcaagcactgaacacctactgtgtgcaaggcacttgatagccttcctgttatttcttcctcactacaatcccatgaagtagttcttatccccattttacaagatacaaaaattgactctcaaaaagcttaagaaatttgcttctagttgcacagtcttatag

SEQ ID NO: 936 - DNA, 401 bp, Homo sapiens
aagagcagattctgttgccaccttcccaagcaggtagtgcctttaaaaaacaaaaaacaaatgttcacctactatatgcattaccatgcaccttacacttttcatttaataaatataccccagcaatggtgatagcagattttggaccagcagtggggataaagaaggtcctggtcacctaggtgcctaaagagaagcagrtgaagagagaagaccctggagaaatgttttcctgttttgcacctgcaggtgcttgacatgcctctgaaaatgatctcagtgctgtgcagttccacagctgcagtggtacccacaatgccaaaacttgggatgcaaaggggcgggggtaatgacaaaaatcagggaaggaggaaccatagcaaccacctgatctgcacact

SEQ ID NO: 937 - DNA, 401 bp, Homo sapiens
gtattttatatacctctcttcaatgcctagtgtccttagacagtaagctccctgaagacacaggctatgcctactttattcatcatcgtgtcttcagtgcctagcaccctgcttggtatgcattcggttcatgaatatatgagggaacctgctgctgctgttcagcattcacacctccatttcaaccccatcagaaccttyttcatgcttcctcttttgtagtgtctcagaaactcattctgttttcttcttcatctttttttttttttttttttaatggagtcttgctctgtggcctaggctggggtgcagtggcatgatctcagctcagtgcaacctccacctcctgagttcaagcaattctcctgcctcagcctccctagtaactggggctacaggct

SEQ ID NO: 938 - DNA, 401 bp, Homo sapiens
ttttttttctctccaaacaactggttacccacacttgtacagtcatgtagagacaaaatgctcatttataattccagataccccatgtaattattgcctatgataatcaggtaatctttatgaaactattcctatacaattttcaaatctcagtttacaatcatgagtattttaccataatcttcataatgccctcttgawtatatttgcttaatatcattttgaatttagtgatatttaagttaacatattttatatgttttcatttcattagtaggcttttaaaaatttacttttttgtgagaatctgatttttgtgagactctgtgaacaaatatcctcactaattctttctaatggtataatgtgaatttgtcattgacaagtgttacaaaaaagac

SEQ ID NO: 939 - DNA, 401 bp, Homo sapiens
ttcattccttctttgtcaagccccctaacttccctaaacttcagtgccctcatcttaaatataatgacataatagtgtctctcataagattggtagaattacatgggataattcatcttgcatggtcaggggcacggtctcgggaaccagactgtgtgggtttgagctgctcagtcttggacaaaagattaaatatatctrtgcctttgttttatcatctataaaatgggaataaccatagtaccttattcaaaggttgttgtgaagattaaaataaattaatcctgtaaaaatgcttaggtttctggcacatagtaagggcttagtaaaaactaggtatttttacctggtatgtgcaagcactgtatrtatcctgatatactttctcatctataattctg

SEQ ID NO: 940 - DNA, 401 bp, Homo sapiens
gctcagtcttggacaaaagattaaatatatctrtgcctttgttttatcatctataaaatgggaataaccatagtaccttattcaaaggttgttgtgaagattaaaataaattaatcctgtaaaaatgcttaggtttctggcacatagtaagggcttagtaaaaactaggtatttttacctggtatgtgcaagcactgtatrtatcctgatatactttctcatctataattctgtttctgtgcactagtttatatatttatttaatggaattattttctacagatttagtcagattttagaacacaaagcaagtggatacttagtagccataggggaatctgattttgatgtctcctacccaaagtttattcatatttaatattatatatacataagtctta

SEQ ID NO: 941 - DNA, 401 bp, Homo sapiens
aaattttataaacaagaaggctgggtttgttttttttaagtttttctgtttttaaatttctgtttatttagcgggtacaagtgcagttttgttacatggatataactctggtctttcagtgtaaccatcactcaaatagtgtaccttgtacctattacgtaacttgtcattcctcaccctcctcccaccctcccatctttytgagtctccaatgtctattattccaccctctatgtccatgtgtactcattatttagttcttacttataagtaagaacatgcaatatttgactttctgtttctgagttatttcacttaagataatagccttcaggtccatccatgttgctgcaaaagacatgaattgattcttttgtatggctgagtagtattccatggtg

SEQ ID NO: 942 - DNA, 401 bp, Homo sapiens
tatcagtcatcagcttaatctcaaaatattgtgtgctccataattgaccttcattagggcattatggacaggggcttactatatgctaagctatgtaaatacagatgctcctcagcttataatggggttgtctggataaatccattgtaagttgatccacacataaccctattaaaagtcaaagagcatactgaatgtgtwttgcatttgcaccattctaaaatcaatgtgtcccwtgtgtaaaatcagttgcatccgaaaagcctgaaacgtgtacatattctttgatctagccatcttattctaaaaatcaaaataaaatcaaaataaaatcaaaatataggtaagttgaactgtcataagttggggaccatgcgtactctgatagtcagtgttatgta

SEQ ID NO: 943 - DNA, 401 bp, Homo sapiens
ctccataattgaccttcattagggcattatggacaggggcttactatatgctaagctatgtaaatacagatgctcctcagcttataatggggttgtctggataaatccattgtaagttgatccacacataaccctattaaaagtcaaagagcatactgaatgtgtwttgcatttgcaccattctaaaatcaatgtgtcccwtgtgtaaaatcagttgcatccgaaaagcctgaaacgtgtacatattctttgatctagccatcttattctaaaaatcaaaataaaatcaaaataaaatcaaaatataggtaagttgaactgtcataagttggggaccatgcgtactctgatagtcagtgttatgtatgaacttgaccaagccgcagggtcccagacatttg

SEQ ID NO: 944 - DNA, 401 bp, Homo sapiens
ggctctcctggttctcaggccttcagatttagactgaaactacactatcagcattcctgagtctccaaattgctgactgcagatcttatgactttccagtcattccattccttgtcataactctctttctctttctttctctctctctcctctctctctctctctctctctctacatatatatatatatatatatatatayatacatatatatatatatatatatatgaacagatacatcctattggttctgtttctctggagaaccctgactaatatacagttatgtgtcacttaacaataggatataytccaaaaatgtgtcattaggcaatttcatgatttgtgaatatcatagaatattcttacacaaacctggatggtttgctgcacacctaacct

SEQ ID NO: 945 - DNA, 401 bp, Homo sapiens
ccttgtcataactctctttctctttctttctctctctctcctctctctctctctctctctctctacatatatatatatatatatatatatayatacatatatatatatatatatatatgaacagatacatcctattggttctgtttctctggagaaccctgactaatatacagttatgtgtcacttaacaataggatataytccaaaaatgtgtcattaggcaatttcatgatttgtgaatatcatagaatattcttacacaaacctggatggtttgctgcacacctaacctgatgcacactgaggctttatgggatagcttgttgctcccagactagaaacctgtacagcatattactgtactgaatactggaggcaatttctaacacaatgacaagtat

SEQ ID NO: 946 - DNA, 401 bp, Homo sapiens
tggctctttggccttcacctgtctgcattatggttatagctgagatgccaggaaaaacacaagatgagtctgttcagctcgaagctgactcaactggtttctaccacctcaattcaaactaggaatgagatatttttcttcctttgctttttagggcaattaatgttcccacatatctccctttttcttgccatttcttarcatcctaaacactaattttgcaaaataatgttgtaaatgctttgcatagtcactatcttatgttgcccttcctgttcacaagacagccgtccgtgtcagttgaagatttctatagatatgcatcatctctgatagataaaggcatgtttcagagactatcctggtgggagtattttacttttgaaaccaactaaatctgg

SEQ ID NO: 947 - DNA, 401 bp, Homo sapiens
tgtcattttcttcagtgattttttttccttgggttgttcttatttctacatcattatgtttattatatgaaggaagcagtcagcctcatgtttattctctggtagagaagaggaaaacagtaatttttgagcatgaatgcataagaccatacagtttatggaaatggctgtagcttctctaacctttcccctttcatacayacttgtttccatgtacacttcattccccctttttccccctttaactctctttgtatttgtatccctccttccctatgccctttttactcaattcattccctacatcacaacctgtggtttttgtatctgatcatagttttcaccctattgaaaatcatggctggccaagtacatgttaacaggaaaattctggacagtcc

SEQ ID NO: 948 - DNA, 401 bp, Homo sapiens
atcatagttttcaccctattgaaaatcatggctggccaagtacatgttaacaggaaaattctggacagtccctttgtacacaaaccttactgcttagtttcatctgtgcagattgctgtatactcagccctgcagcagagagaccacactgcagcctttagtaggaaaaggataggaatgacaatacactgcagacacttycgtgagtaagttgctaaagcgtcagtaaaacatcatggtgaggcctctgcaatcagcctgcttagrtttaaatgacaattctgtcacttacaaatatataaccatttggatagttatgtttgcactttaagcctcatgttagttatctggaatagtatataatattacctacctttagtgtcatcataagaattaaatga

SEQ ID NO: 949 - DNA, 401 bp, Homo sapiens
agtccctttgtacacaaaccttactgcttagtttcatctgtgcagattgctgtatactcagccctgcagcagagagaccacactgcagcctttagtaggaaaaggataggaatgacaatacactgcagacacttycgtgagtaagttgctaaagcgtcagtaaaacatcatggtgaggcctctgcaatcagcctgcttagrtttaaatgacaattctgtcacttacaaatatataaccatttggatagttatgtttgcactttaagcctcatgttagttatctggaatagtatataatattacctacctttagtgtcatcataagaattaaatgatttttgtgatataaagtgttaagtgtggtgccagaccctggcaaagttggtaattgtccccttcct

SEQ ID NO: 950 - DNA, 401 bp, Homo sapiens
gggagggttaatagaatggatatctaaagcagcgattctcgaatataggcttttaaccagcagaatcagcattacttgacccgaaaacttgttagaaatgcaaacacttaagtctcacccctaagctcctgattcagaaaatctagggttagggtttaactgtctgtgttttccttgtttttgtttgtttgtttgttttgycgttgttgtttgttttttgtkgttgttttgttttgtttttgagacagggtctggctgtgttgcccaggctagagttcagtggcacaatctcagctcactgcagcctcaacctcctgggctcaagcgatcctcctacaacagcctctgaagtcgttgggaccacaggtgcaccaccacgcttggctaatttttgtattttt

SEQ ID NO: 951 - DNA, 401 bp, Homo sapiens
atctaaagcagcgattctcgaatataggcttttaaccagcagaatcagcattacttgacccgaaaacttgttagaaatgcaaacacttaagtctcacccctaagctcctgattcagaaaatctagggttagggtttaactgtctgtgttttccttgtttttgtttgtttgtttgttttgycgttgttgtttgttttttgtkgttgttttgttttgtttttgagacagggtctggctgtgttgcccaggctagagttcagtggcacaatctcagctcactgcagcctcaacctcctgggctcaagcgatcctcctacaacagcctctgaagtcgttgggaccacaggtgcaccaccacgcttggctaatttttgtatttttggtagagacagggtttttcca

SEQ ID NO: 952 - DNA, 401 bp, Homo sapiens
accacaggtgcaccaccacgcttggctaatttttgtatttttggtagagacagggtttttccatgttgcccaggctggtcttgaactcctgagctcaagcaatcctcccaccttggcctcccaaagtgctgagatacaggcatgaagtcactgtgcttggcgttttaaccagcctgccagatgattctgaatttgaatatyctggtgagaggttttaaatcatgcaagtggctgtctgcctccagttaaggtaaaaagggaaaggcctcagcttacactgtggttgagccatatgacaggacatacaaacactattaatattactagagaagcaaccagcaccgttttgaatagctcagtctattgggggtgtgccttctactcaagatgtaaataaggat

SEQ ID NO: 953 - DNA, 401 bp, Homo sapiens
ttttcttaaggatcaaaattaaaaggtggaaatatacaaacgctaaataatggaattaagcattggccttggataacagaaggtgaaggagataagagacaactttctgttccagctccactttaaccacaggggacataaatatatgggaccttgtagtatttaaccttgttaatatctccatactgttttgcagtaggygttggaacagagcttcacatttttctggtggaggagccagtgatctctggatggtgaaaatattctctaaaacagactccacaactacaatgaccagtacaatgtgttttctatgccgctgtcctctgtcaaggggcatcacaagtggctggcctatattcatgtaaaggtagaactagamcccaatcaatgtgccctat

SEQ ID NO: 954 - DNA, 401 bp, Homo sapiens
catactgttttgcagtaggygttggaacagagcttcacatttttctggtggaggagccagtgatctctggatggtgaaaatattctctaaaacagactccacaactacaatgaccagtacaatgtgttttctatgccgctgtcctctgtcaaggggcatcacaagtggctggcctatattcatgtaaaggtagaactagamcccaatcaatgtgccctataaatacccaagtctttaaatacccttagataataaaggtaaaagatgcaagaaaaagaggactgggagagtggrccaagtttatagttctttcaaagtctatttgaattatttaaaaccattctttttttgttaatagattttaattctcatacatgtcacatgtttcttttgcagaattc

SEQ ID NO: 955 - DNA, 401 bp, Homo sapiens
agactccacaactacaatgaccagtacaatgtgttttctatgccgctgtcctctgtcaaggggcatcacaagtggctggcctatattcatgtaaaggtagaactagamcccaatcaatgtgccctataaatacccaagtctttaaatacccttagataataaaggtaaaagatgcaagaaaaagaggactgggagagtggrccaagtttatagttctttcaaagtctatttgaattatttaaaaccattctttttttgttaatagattttaattctcatacatgtcacatgtttcttttgcagaattcaaaacatttttaaaaacacccatttcaataatattgcatgcaaggtaaacaagaggttagaataactagtacaacataacgcagcttgactag

SEQ ID NO: 956 - DNA, 401 bp, Homo sapiens
ttgtgacttaatggtggcttgtggctccacttcccttgggggttgtttttgttgttcttctctcaggaccacatttattttgatgttttaaaagagaaagaaaagttccaaaaacttcctttctcgtatttcctctttgagatccagcaaaatttctacaactggccttttccagatggcttgcccagaattgctgagagwttgaggcacctcaagctctgggctcaacatcgaaggttctttaaatgtgccttttatcctttagtttctgtcacttgatgatgggtgaccaccctcatctctctctctctctctctcttttttttttttcctactaaacatgagattactggaaatatttcatgattggatacatgctattggttaatccatttaaccaa

SEQ ID NO: 957 - DNA, 401 bp, Homo sapiens
aaggggcttcccccttcacttggcactcactctgtcctgccccttgtgaagagggtgcctgcttctcctttgccttctgccatgattgcaagtttcctaaggcctccccagcagtgtgaaactgtgagtcaattaaacctcttttctttataaattacccagtctcaggtatttcttcatagcagtgtgagaacagactartacactcatcttttgaatacattatgtgaagtacaacaattttttccaaaccaaaccagacctggctaaatcctttactatagaccccaagattgagagagagggaaaaaggaattgatctgaatcaaatttgctgttatcaagaagtagggtagggaagggaccaatatgagatgtacgaaaattggctcccaaagtac

SEQ ID NO: 958 - DNA, 401 bp, Homo sapiens
aacatttttgctctcataacaatgctctgatgaacctcatgcattcatctttgagcttttgaccaattttccttctgtggtaaattcctgaaagtagaattgttgggacaaaagatttagagattttgtatctttaaacatattaccagtttgccaacccaaagggtcatatgagattactttctgcctacagtgtagtaragtgccagcttctcccaacaaccttgccaacgttgggtattgtcaattttttggctctttgccaagctgataggagaatggaatgtctaatggtttttgaattacattctgactgtgctgcatcagactgtaactgaatgcagttgtgatgtatcaggggacctggtttaactcagcacactgtttgaatctgtgtaata

SEQ ID NO: 959 - DNA, 401 bp, Homo sapiens
ttggtacttattgaaaagcagctattgttttaagtcctttgcatatacatttctatgatttactatatatcagtagcatttctccaacccatcttggctaggcaagcaccactgaatatgaaggaggccaaatagaatgatactatccaagctgcaaagaaacaaacaaaagaaaacatctaaatgcatgcctctttggartggcatttgcatccgttgccaatatccatagaacaaatgccttcaggcaggaagaagttgggataatgtcaatgtttttaatagctgtagtagagtcctatttagaaagcagtaattatctctccatattgattttttacatcccctcaataaatccagaagaaatgtgaagaccatctgtaagtgtgatttttaccagg

SEQ ID NO: 960 - DNA, 401 bp, Homo sapiens
atctaagagatctagagcccatattgcccacagagctgaaaacatatgtacatctaaccctttgcaggaaaaaacttgttaaatcatgattgagattatagtagtattatttctgattgactaggtagtaattggtcccagcatgtaaagtttctaatattaaagtcacacgatagaggagctagaggcttaagaaaagtrtacatgaatttatttatttggaataggaagggaaacatccctggtatcatcatgatggcatatagaggcagggctgagagctagaatacagaatacgtcctttgctagaaacagtttctcgggctgggttagagtgggtagaaactatggatcatcctgccgcaggtccaagtaaacaggatttggcgctctacataatg

SEQ ID NO: 961 - DNA, 401 bp, Homo sapiens
taaatatataacatccactgagtgttggccagcgttgactgggggttgttctccacatcacgtccctaagggaccaacagtgttggaggagtctctcttctcatattgatgttcaccatggcaaaggcaatgatcacagtgaaccacatgctacattttaagcttctacctggacaccacacaagtcacttccactcccakttcggtggtaaagcaagtcaattcaagtctgacttcagcatctttgggaaatataattccaccccrrgaggggaagcagatatgggtgaaatgtaataaaattcacctctcccataaagtcctagtagcattgttttatttgagtgaattcttttttttttttttcttccttacagatcctctttaaaacatcagcctgg

SEQ ID NO: 962 - DNA, 401 bp, Homo sapiens
taagggaccaacagtgttggaggagtctctcttctcatattgatgttcaccatggcaaaggcaatgatcacagtgaaccacatgctacattttaagcttctacctggacaccacacaagtcacttccactcccakttcggtggtaaagcaagtcaattcaagtctgacttcagcatctttgggaaatataattccaccccrrgaggggaagcagatatgggtgaaatgtaataaaattcacctctcccataaagtcctagtagcattgttttatttgagtgaattcttttttttttttttcttccttacagatcctctttaaaacatcagcctggaaacagtatctgtagaaatcagttttgttagttctaaagcagggcttcattgttgggatgtgttgt

SEQ ID NO: 963 - DNA, 401 bp, Homo sapiens
aagggaccaacagtgttggaggagtctctcttctcatattgatgttcaccatggcaaaggcaatgatcacagtgaaccacatgctacattttaagcttctacctggacaccacacaagtcacttccactcccakttcggtggtaaagcaagtcaattcaagtctgacttcagcatctttgggaaatataattccaccccrrgaggggaagcagatatgggtgaaatgtaataaaattcacctctcccataaagtcctagtagcattgttttatttgagtgaattcttttttttttttttcttccttacagatcctctttaaaacatcagcctggaaacagtatctgtagaaatcagttttgttagttctaaagcagggcttcattgttgggatgtgttgtc

SEQ ID NO: 964 - DNA, 401 bp, Homo sapiens
cagggtgagagtttggtggcacggagtgaggctagaggtgggcgtgtggagagtctgatatcctgatatcaaagcaattccattcagacttaggcctgagctgctcccagtcatccaagtcatttttactaatatctgacaacttgcaaatattgtgttacgttcaacactgaaaatgaggactgtgcatttccttttgtytaaatgatgattaaatggtgaagcagctacagaagtattgactaacgacagcatccatttactagaaaatatgtcatttgctactgcaaacatttatggtctgattatacctcatgttacactgcaatggtttgggttttttttttttttttgtatttttggtacatcagaaacacttttcccaatgtttgttagtttaa

SEQ ID NO: 965 - DNA, 401 bp, Homo sapiens
atgattaaatggtgaagcagctacagaagtattgactaacgacagcatccatttactagaaaatatgtcatttgctactgcaaacatttatggtctgattatacctcatgttacactgcaatggtttgggttttttttttttttttgtatttttggtacatcagaaacacttttcccaatgtttgttagtttaagcattgktcaacatttatttattaagcattgactttataaaataggtaccaggaatatgaaaatgagtaagatatgttccctgacatccagtagctcatagtctagagatgtcaccataataataactagcatttattggacaccacctgtgtctcctgaagcctgttacctcatttaattttgacaaaaccttatgaagtgaatat

SEQ ID NO: 966 - DNA, 401 bp, Homo sapiens
  misc_feature (1)...(401): n = A,T,C or G
attctttgaaatctgaaataagtcctaaccttatacattcaccaggagtgtgtattaatcacttctcacactgctgataaagacatacctgagactgggtaatttataaagaaaaagaggtttaatgaactcacagttccacatggctgggaagacctcacaagcatggtggnaaagtgacaggcacatcttacatggcascaggcaagagagaatgagagcaaagcaaaagggaaaacaccttataaagccatcagatctagtgagacttattcactaccacgagtattgtgttgagggaaaccacccccatgattcaactgtcttccaccaggtccytcctacaacacatgggaattatgggagctacaattcaagatgagattcagatgggaacacag

SEQ ID NO: 967 - DNA, 401 bp, Homo sapiens
  misc_feature (1)...(401): n = A,T,C or G
ccacatggctgggaagacctcacaagcatggtggnaaagtgacaggcacatcttacatggcascaggcaagagagaatgagagcaaagcaaaagggaaaacaccttataaagccatcagatctagtgagacttattcactaccacgagtattgtgttgagggaaaccacccccatgattcaactgtcttccaccaggtccytcctacaacacatgggaattatgggagctacaattcaagatgagattcagatgggaacacagccaaaccatatcagagtgtatactttcattttattcctcaatcttcattccttaagttttcaacaaataatttgcttttgaaaggattaggagcttaagttggctttatagttatccagtaaccttttgatttctcca

SEQ ID NO: 968 - DNA, 401 bp, Homo sapiens
actatgttttcagtaggacatatctgatggaaatacatttcttttgatattatttattataactggtgagctacattccacccaatagtaaatgcctctcagcaaaaagatagatacttttgatagttaatatattcagatattatgttgtttgtggaaaccataacttaataaattttaaaacagtgtcttctttaaaartaattttttattaaactttgtattttgaggtaattgtagattcacatgcagctataagaaataatgcaaacaatactttttacccagtttcctccaatggtgacatcttgaaaactatcgcacaatagcacaactttgatattgacactgatacaatcaagatacagaacattttcatccaggcatcccctgtgcttagc

SEQ ID NO: 969 - DNA, 401 bp, Homo sapiens
ctataagaaataatgcaaacaatactttttacccagtttcctccaatggtgacatcttgaaaactatcgcacaatagcacaactttgatattgacactgatacaatcaagatacagaacattttcatccaggcatcccctgtgcttagcccttttgtagctacgtctacttcctttgcccaccctcaccttaaaaccctgscaataattaacattttgtcatttcaagcatgttatataaatggaaccatagagtatataactttcaggtattggttttttccaatcagcataattctttggagattctttacttagcatacttctctggagatttatctaggtgcttgtgtactagtagttcattctttgttatcgctgcatagtatttcatgctaggga

SEQ ID NO: 970 - DNA, 401 bp, Homo sapiens
tccacaaggcaagagcttttaattttgataaaaataactttttatacttaattggcaaccaaatacctaaatgtcttttgatagaaaaacttgtcctagataatgtaaaatcattttacatattcacagatccatctccactaatgtcatataagtttaaaaatcacaaagtaatttgaacagattcctaaattataaatyagttaacagttattttttgctctaatctttagttgtacatttacttcaaataaacatttgttaaaaacgtactctgtactgaggaatgaggatacaaaactcataatttgtcatttctttgcttcagggacttacattttactggattacatctaaatttttatttggcagttttattccaggaagatcatgacagtctt

SEQ ID NO: 971 - DNA, 401 bp, Homo sapiens
gactgaatcagttcaaagagcctcgatagctttaaatgtctgtgattgatttttctgcagagcaagatcaaacaaaacagtatttcctagctgctgcccttacatgtagtggtgattcacagagaatttggggaggaaagtagccattatgggatgttttgcaaaaggcaataccaagattgatcatcacctgagggcgayacactatagttgttcctctgtatccatgacagattagtcccaggaccccttgcagataccaaaatccacagatgctcatgtcctgcttataaaatggcatagtatttgtacacagccttgtatatcctcctgaatactttaaatcatctctagattacttataatacctagagttgtataaatgctatagaaagtattgt

SEQ ID NO: 972 - DNA, 401 bp, Homo sapiens
aaacaaacaacaatgatactggccaactgacttctctcacttctctcttctcttttctttaattcattccttacctatttagaatagctgaggctcatttttatcttcttatgacagccagaattgtcatctattaagattaagtaaggaaggcataattgatattcacaaaccaccccaggatttatcagaagtgagggwgtttcatatggattactaattgtctaaaatttggctctaagcacctgaagatcactaggcaggagagaagagtagggtttgttgtacatgagaagaggctgtggggtgggggatgttcaccgagaagactgctttggtctttgatactagcatttttccttctatatggttaacaaggcacatattttcatttttatatc

SEQ ID NO: 973 - DNA, 401 bp, Homo sapiens
tgtggggtgggggatgttcaccgagaagactgctttggtctttgatactagcatttttccttctatatggttaacaaggcacatattttcatttttatatccccagaataaaggcttgaaaggaaacaaaatctcaaataaatggactaatttgttaaattctggactaaacctcagtttattttaacagctttaacaackgtctctggagctcataacacatatagagcactattggtgtcacacaaaaccttgaaatcagaattgccacagaccgaatctgatctgaaatggcatttcattcaactgcagctttgtgtcacaagaacctgtctctgttttcctaacatgggtatgatgcatattcagaagcagccgagtgatttacttcttttttcatt

SEQ ID NO: 974 - DNA, 401 bp, Homo sapiens
ggctggtcttgaactcctgacctcgtgatccacctgcatcggcctcccaaagtgctgggattataggcataagccaccttgcttggccctaaaatacttttaataagattgtctcatccttctcttggttttccaatggaaatggtggtatagcaagtccatctgaaacacttctgcaaaataacaatgaagctaatcacygtgggaaacatttacatcatatgtatttgcatacagaggaaattgataatcttgagacatcagcatactagaatagcaagagacatgttttattctattatattctcttagtcagcaatktttaattgttgcttaaaggaaactgaataaaacgtgggcgcagtggctcycacctctaatcccagcactttgggaagttg

SEQ ID NO: 975 - DNA, 401 bp, Homo sapiens
tctcttggttttccaatggaaatggtggtatagcaagtccatctgaaacacttctgcaaaataacaatgaagctaatcacygtgggaaacatttacatcatatgtatttgcatacagaggaaattgataatcttgagacatcagcatactagaatagcaagagacatgttttattctattatattctcttagtcagcaatktttaattgttgcttaaaggaaactgaataaaacgtgggcgcagtggctcycacctctaatcccagcactttgggaagttgaggagagaggatcgcttcagcccaagagtttgagaccagcataggcaacatagtgagaccccatctctacaaaaaatattttttaaaattagtcgagcatggcggtggctccctgtagtt

SEQ ID NO: 976 - DNA, 401 bp, Homo sapiens
cttctgcaaaataacaatgaagctaatcacygtgggaaacatttacatcatatgtatttgcatacagaggaaattgataatcttgagacatcagcatactagaatagcaagagacatgttttattctattatattctcttagtcagcaatktttaattgttgcttaaaggaaactgaataaaacgtgggcgcagtggctcycacctctaatcccagcactttgggaagttgaggagagaggatcgcttcagcccaagagtttgagaccagcataggcaacatagtgagaccccatctctacaaaaaatattttttaaaattagtcgagcatggcggtggctccctgtagttccagctacatggagggctgaggtgggaggatcacttgaaccagggaggtc

SEQ ID NO: 977 - DNA, 401 bp, Homo sapiens
tagaacattattttaaagtttaggtatttcatctgagtatattactctggctttcctaagctagcttagttatatatgttcacttcagtttgagtctccactaaattttaacatgaacaaaatattatatgcaacaccatagaagcaattgttaaatcattgttacttttaatatcacctaaatctaacctaagtaaatgygtttatttttattaccaactgatgtagatatacccacatggacagaaaacagcataaaccaccaaaaggacttgaaaattccctcttcaagacttcttttgccaatgactaatgtttaatgctatttgctagagattctggtgccaggaggatttctaaccaggttattttatcaataggaataaaatatcgagggctta

SEQ ID NO: 978 - DNA, 401 bp, Homo sapiens
cacatggacagaaaacagcataaaccaccaaaaggacttgaaaattccctcttcaagacttcttttgccaatgactaatgtttaatgctatttgctagagattctggtgccaggaggatttctaaccaggttattttatcaataggaataaaatatcgagggcttaaattagtgtaatctctcaagatcttgaatttgacrttttcataatttttacttaatcatagctcctggggattggaattactcttttagctggcccgagtctgggaggaggatccaaagtctttgagttgttttcttttatttctttttagcccctaaagcactggaaatggttggccctgaagtgctcctaaggtaaccgcaagatgaggcaaaacaggattgagatgaaaacc

SEQ ID NO: 979 - DNA, 401 bp, Homo sapiens
gcctgggcaacagagcaagaccttgtctcaaataataataataatatataaataaacaaataaataaaattatcctaagtgaaatcagttgttgatagaactgaagtacatcaagcctagtgggactgtggttgtctctccagcctaaaaaaaaaaaagaacaaaaacaacaacaaaaaaacttaactccaaaattgctgytgctccatttatttcaggtgtaagacttctttgagatttaaaaacaatataatcatttacaatgtactttgttggacctaagcataggaaaattcattcattcattcattcattgagtacctgttatatgccaggcaatgcactaggcaccatcaaagatgaataagctatgtgctaaaattcacagtctaacagaagaa

SEQ ID NO: 980 - DNA, 401 bp, Homo sapiens
gtcaccacacctggctattttttgtattttttgtagagatggagtttcaccatgttgcccaggctggtcttgaactcctaggctcaaatgatcctcctgcttccaccttccaaagcgctgagattatagacgtgaaccactgcacctggtctagaaattatttaataataaaaaaatgaagacagaattcaatgaagagcrtagaagagtctcttaaacctytgttttaagctatgagccaggaaagagatggtggcaagggtgagatggttgcagtgcttttttgttcacttatctcaggcctgtgtgttctgagttaaagacaagtcagttggcaagagaaggagagaggaagcttcccagaaccatttgaaggaaaatttggaaagtcttctctaagg

SEQ ID NO: 981 - DNA, 401 bp, Homo sapiens
ttgtattttttgtagagatggagtttcaccatgttgcccaggctggtcttgaactcctaggctcaaatgatcctcctgcttccaccttccaaagcgctgagattatagacgtgaaccactgcacctggtctagaaattatttaataataaaaaaatgaagacagaattcaatgaagagcrtagaagagtctcttaaacctytgttttaagctatgagccaggaaagagatggtggcaagggtgagatggttgcagtgcttttttgttcacttatctcaggcctgtgtgttctgagttaaagacaagtcagttggcaagagaaggagagaggaagcttcccagaaccatttgaaggaaaatttggaaagtcttctctaagggagttgccctcaactaccttt

SEQ ID NO: 982 - DNA, 401 bp, Homo sapiens
aattataatttttctcaaacttcccaaaagtggaacattgtgggaaataatatgggagtggacatttgaatttctgtttgactttgcagcagaaatctcttttctaactctctctttcaatctcaccatcagagccatctgattgcttgataacatgattctttttgcccagcccttgttatcctccctcctgccctagtmaccatgacataggctccactcatttctacctaggaacctggatgcactgctttgcactattgcctcctggcaaaacagggcaatgagaaaggaaatggaagcccaaattcagagccctccttcccagcacaagaatgaggagatgccctttttccccggggagggggattcttccctctctcttcagtaattgtctttat

SEQ ID NO: 983 - DNA, 401 bp, Homo sapiens
ttttttgacatgtattatttgatgaaaccctatgagattaggtctttacttccgaaagaagaaaaccaaattcaagggcaattaaaaacttgtcaaatgtctcaattttagtaagaaaaaaaaccgacattggcctagatcttaatctgtgcccagtcctcttcccatccctctttttttttttttttttttttttttggkgggctgctctcaaatttttgggctcaaatgaacctcctaccttggcctcccaacgtgctgagattacaggcatgagccaccgtgcctggccagctaaggttaatttagtattgaaraaatatttttgttatgaatttagtgtagccaagtgtgcagtgtttaraccatctacagtaatgcacattaatggcctaggcctt

SEQ ID NO: 984 - DNA, 401 bp, Homo sapiens
aaaaaaaccgacattggcctagatcttaatctgtgcccagtcctcttcccatccctctttttttttttttttttttttttttggkgggctgctctcaaatttttgggctcaaatgaacctcctaccttggcctcccaacgtgctgagattacaggcatgagccaccgtgcctggccagctaaggttaatttagtattgaaraaatatttttgttatgaatttagtgtagccaagtgtgcagtgtttaraccatctacagtaatgcacattaatggcctaggccttcacattcactcaccactcactcactgactcacccagagcaatgtctagtcctgcaagctccattcatgggaaaggcctcacacatgtataacatttttttgtcttttattctgtat

SEQ ID NO: 985 - DNA, 401 bp, Homo sapiens
cccatccctctttttttttttttttttttttttttggkgggctgctctcaaatttttgggctcaaatgaacctcctaccttggcctcccaacgtgctgagattacaggcatgagccaccgtgcctggccagctaaggttaatttagtattgaaraaatatttttgttatgaatttagtgtagccaagtgtgcagtgtttaraccatctacagtaatgcacattaatggcctaggccttcacattcactcaccactcactcactgactcacccagagcaatgtctagtcctgcaagctccattcatgggaaaggcctcacacatgtataacatttttttgtcttttattctgtatttttctatgtttagataagtttagatgtataaatacttatccttgta

SEQ ID NO: 986 - DNA, 401 bp, Homo sapiens
gagtgcaatggtgcgatctcggctccctgcaaactctgcatccggaattcaagcgattctcctgtctcagcctcctaaatagctgggactacaggcacgcaccaccacgtccagctaatttttgtatttttagtagagacggggtttcactatgttggccaggatggtctcgatctcttgacttcgtgatcctcccgcctyggcctcccaaagtgttgggattacaggcatgagccactgtgcccggcctcatgtagagcactttaaaagtacattggatccatagtaatcacttaactatgaacttgtatatccatatcaaaacttcatgttgtacagcttaaatatagacaataagaataaaataaataaatgaaaatattttaatatgctgagccatg

SEQ ID NO: 987 - DNA, 401 bp, Homo sapiens
taccatacatatactgatgacacctaacactctagttctcgtctgtgtctccctgaactccagactcgtaggtccaactgacttctgcatatggctgtccagtcggcatctccaattgaacatcgtcagaacaaaacttcaggcttttccccaaccagctcttctggtcttgcccatctcaataaacaccactgctatctrcccaattaattgagccggctatctggtagttattcccttctttgcctcactgtcttctgatccccatatcctataaactctaataccaagtatccctggaatcctttcagtttttcctatctttacttcttctccttagtctaagctattatactctcttgcatagtttagcggtagtttttaagccctttttttatttt

SEQ ID NO: 988 - DNA, 401 bp, Homo sapiens
ttccaagagcacaatacagcaaaaagtgagagttatctatttctcccttcttcatccgaatacaaaatacatcctattttactgctttttttttgtcttttgcctctactttaagacttatctaagaaataaagaaaagccaaccactcgttctatccacagaagaaaaacacacaccagcatagacaacacaaaagactrtgtctagatgttaagactatatatcctataggactataattttcatagatctaaaaagtgagaaacatatatatgtataaaattatgtgggatgcaagttactgagattttgaatatggggctctgtcatttaccctaaaatgttcagtggtcttttctattttttctctattctcagtaaaatagaactttctcaacaa

SEQ ID NO: 989 - DNA, 401 bp, Homo sapiens
tcaaaggggaatttattaacaattttatttctgagaggatatgacaacaacaaagacattaataaaaaacaccagcgagctttctggcaatatgtattaaaattttcaaaaacacttatactctcgaatccagcagttattatttcgggaaattgctctaagaatattatctttttatacaaagcattttctgaagagaaktattcaggaaattttcatttatgaacagaaaaagtccaacattatggaaatagtgatataaaatacagcatatatagttctttggtattttacagtcatgtaatcatggagagaaatacttcagataaattaacataataaaccacaatacaaaaaagtatatttacaatagaaaaaaagtttaaaagtgtgttagcaat

SEQ ID NO: 990 - DNA, 401 bp, Homo sapiens
tttcttcaaagtaaaatgaagtggttaaacaggattactccccagatgtctccccaaactttacactggtgtaataattgtttgcaaggatcattgggtgattatgtctaaaagcctgcagttattagtcctcatatcaggaatgtgctatccccattcattttattgtagaacctggtttgctgtgggatagttgaaatwtgaagaattcacttggtcagtgtgtttcacggccttgctactttttctgcttggatggactcacttctctatatgattttctctttaaatcagaagtatttgacctgaagcagtaactcctctattcatataatagtgatattctgatacatatgtgaatattataaaaataagtagaatgataatattattactaatat

SEQ ID NO: 991 - DNA, 401 bp, Homo sapiens
atataaacacaaagcaacataggagaaaagtactagttacatgcccatggcaagaaaatatgcctgaaatggttctgtttattttgttgttgttgtttctgcttggaatttcagcagttatttggcaaagtgattagctagctgggaaggaagaaagctcgtctccatcagccttttgtcagagcccgccttttggtcccrgagcccccatgaaagtgtgctgtagaccaggaccactgttgccctgaatgcatgagtatgcagcctttttatcgtaggcttgtcatctcctgagttctgcaatagatgccatgtgaaatccagtatatactcagtctaacacatagctgctgcataagaaaatttctttccatgcttaagcaatttctgcatagagctta

SEQ ID NO: 992 - DNA, 401 bp, Homo sapiens
aagtcacaagtgggtgagaaccacaggagagaaacagtcagagggtgatgacagccagaactggtatgatgtgaaaggtcaatgacatcagaaacggcctcagggattttatagcctggctccttcaatttcagttcttggtataggccagcttttcaggactgttgattgtccctcttctttgtgtgaaattcctagtgsacagagcttctgcagtgcctcttaggtactttgaaaatcccaacgataaacatctggacccaacacagaagcctccaggaagctgtcttgttggcagtcacctacgagcaggcgataaacacaacacattaaatagtatgtaatgctccagggattgcagtcctctgcctcctaatctctctgtcctttcctcttttatt

SEQ ID NO: 993 - DNA, 401 bp, Homo sapiens
gagcttctgcagtgcctcttaggtactttgaaaatcccaacgataaacatctggacccaacacagaagcctccaggaagctgtcttgttggcagtcacctacgagcaggcgataaacacaacacattaaatagtatgtaatgctccagggattgcagtcctctgcctcctaatctctctgtcctttcctcttttattgacytgtcaggagcatgacasttgtgcacaaccattagcacacaagaaatgactttcctgtgggggtgatggggactggggaacctactctttgagatagaaagttaccctgatgcagaataattacagtccagcttagcctccttataagcgattaatcttacttttcctcttagcttctgtctgtttgtaacctgaggttga

SEQ ID NO: 994 - DNA, 401 bp, Homo sapiens
cttaggtactttgaaaatcccaacgataaacatctggacccaacacagaagcctccaggaagctgtcttgttggcagtcacctacgagcaggcgataaacacaacacattaaatagtatgtaatgctccagggattgcagtcctctgcctcctaatctctctgtcctttcctcttttattgacytgtcaggagcatgacasttgtgcacaaccattagcacacaagaaatgactttcctgtgggggtgatggggactggggaacctactctttgagatagaaagttaccctgatgcagaataattacagtccagcttagcctccttataagcgattaatcttacttttcctcttagcttctgtctgtttgtaacctgaggttgaccgaagttagttctttt

SEQ ID NO: 995 - DNA, 401 bp, Homo sapiens
agatagaaagttaccctgatgcagaataattacagtccagcttagcctccttataagcgattaatcttacttttcctcttagcttctgtctgtttgtaacctgaggttgaccgaagttagttcttttagttggttcttgagaaaaccctttcagtctgtatttccaggaataaatcttaactctaatttaaaaaacaaaarggccctataaatagttacttcaaaccctttaatttatagctgcattctcaatgtcttcatcctcccaaaatcactcacctctacatttttgccctaagtacctaggttagcacaacttttcacaacttctctttaacatttctctgaataacgtgaaccttccttatttccttaaaatataaacttatatatgttcttcc

SEQ ID NO: 996 - DNA, 401 bp, Homo sapiens
ttggaagtgtctcttcttttggaagtgggagaccaagtggaggggaagaacatgaacaagggattgaagccattgagaaagtcatttattcattcgatagatatcttctgagcactgcgctaggacctaaggacagaataatgaaggcagagtttatccttccactagcacagcagtcaaaaccaataggaattaagattrtcagaagtgacaaaactgtacatagacctgttcacataactaacaagggaaacgatggaggtgatrtggaagtctgaacgtggtgcaggaataactcagccaacatccccctcctttgggaaatttagatagatgtaggtagattgagaagtgatataacagtcatgtggcatcattgagagagtcagttttctataatg

SEQ ID NO: 997 - DNA, 401 bp, Homo sapiens
aagccattgagaaagtcatttattcattcgatagatatcttctgagcactgcgctaggacctaaggacagaataatgaaggcagagtttatccttccactagcacagcagtcaaaaccaataggaattaagattrtcagaagtgacaaaactgtacatagacctgttcacataactaacaagggaaacgatggaggtgatrtggaagtctgaacgtggtgcaggaataactcagccaacatccccctcctttgggaaatttagatagatgtaggtagattgagaagtgatataacagtcatgtggcatcattgagagagtcagttttctataatgacaaagacatggaaagagagatgtttagtacatgtacagcagaaggagttgattcacaacgcaatg

SEQ ID NO: 998 - DNA, 401 bp, Homo sapiens
agcagggttattattaaaactctgatcccccaagtccaactgaaggggctccagtcactaccccatcatctcagtggtgagatgtagtcaaggcatctaacctctctgcctcagtttcctcatatgtaaaatagagacaatcattataaagtgtttagcagaatgccagatccacagtaaatatcagtaaaaggaaatttrtaaatttgtaaattgttagggaatggggtgagaccctcaagattctaatcttcaagggaaagaggatgctaaggaaagtcagaggaagcccgagaatcctaagagaggatgatacaagcaaattaattaaggaataagatcaaagaatattgggaaatgtttaatccacttggtgtgggaaaaggacttttwtgtttgtt

SEQ ID NO: 999 - DNA, 401 bp, Homo sapiens
ggaaatttrtaaatttgtaaattgttagggaatggggtgagaccctcaagattctaatcttcaagggaaagaggatgctaaggaaagtcagaggaagcccgagaatcctaagagaggatgatacaagcaaattaattaaggaataagatcaaagaatattgggaaatgtttaatccacttggtgtgggaaaaggacttttwtgtttgtttgtttttgagacggagtcttgctctgtcgcccaggctggactgcagtggtgcgttctcggctcactgcaagctccgtctccctggttcaagcgattctcctgcctcagcctcccgagtagctgggattacaggcgccagccacaacgcccacgcccagctaattttttttttttttttttttgtagtagaga

SEQ ID NO: 1000 - DNA, 401 bp, Homo sapiens
ccgcccgcctcggcctcccgaagtgctgggattacaggcgtgagccactgagcccggccgaaaaggactcttttttttttttttttacacagagtctcgctctgttgcccaggctggagtgcagtggcgccatctcggctcactgcaagctccgcctcccgggttcacgccattctcctgcctcagcctccagagtagctsggactacaggcgcccgccaccacacccggctaatttatttatttttttctttttttcttttttgtatttttartagagacggggtttcaccgtgttagccaggatggtctccgtctcctgacctcatgatccgcctccctcagccttccaaagtactgggattacaggcgtgagccaccgcgcccgaccatgaaaaggac

SEQ ID NO: 1001 - DNA, 401 bp, Homo sapiens
tttttttttttttacacagagtctcgctctgttgcccaggctggagtgcagtggcgccatctcggctcactgcaagctccgcctcccgggttcacgccattctcctgcctcagcctccagagtagctsggactacaggcgcccgccaccacacccggctaatttatttatttttttctttttttcttttttgtatttttartagagacggggtttcaccgtgttagccaggatggtctccgtctcctgacctcatgatccgcctccctcagccttccaaagtactgggattacaggcgtgagccaccgcgcccgaccatgaaaaggactctttttaacctcttctccatgtctaatctgagtttcaacctttttattcttattctgttataagtacttctc

SEQ ID NO: 1002 - DNA, 401 bp, Homo sapiens
tgtgtttgctggtactgaatcctaccctaatacttccgaaatgaacctcattggataactcaactcttcattatgtttttgctaatcttttaggagcctttttgcaacccaccgtctccctaccctcgttgggtctttttttttttcttcttcagtcagggttttgctctgtaacccagtggggaaagtggcatgatgatrgctcactgcagccycaaattcctggactcaagctattttcccgccttaccttcctgagcagctgggactataggcgcatgccatcatgcgtggctaatttctaaaaaatatatatttttgtagagacatctctctatgttgcatttctggtcttgaactcctaggcgcaagcaatcctcccacctcagcctcccagagtg

SEQ ID NO: 1003 - DNA, 401 bp, Homo sapiens
ctgaatcctaccctaatacttccgaaatgaacctcattggataactcaactcttcattatgtttttgctaatcttttaggagcctttttgcaacccaccgtctccctaccctcgttgggtctttttttttttcttcttcagtcagggttttgctctgtaacccagtggggaaagtggcatgatgatrgctcactgcagccycaaattcctggactcaagctattttcccgccttaccttcctgagcagctgggactataggcgcatgccatcatgcgtggctaatttctaaaaaatatatatttttgtagagacatctctctatgttgcatttctggtcttgaactcctaggcgcaagcaatcctcccacctcagcctcccagagtgctggggattgcagg

SEQ ID NO: 1004 - DNA, 401 bp, Homo sapiens
gtggcgcgatatcaactcactgcaacctctacccctgggttccagtgattctccagcctcagcctcctgattagctgggattacagacacccgccatgacaccctgctaatttttgtaattttagtagagacagggtttcaacatattggtcaggctggtctcgaactcctgacctcaggtgatccacccaccttggtctytcaaagtgctgggattacaggtgtgagccacygtgcccggcccttggcctttattcyttattttccctgatattaatccctaatgaaatgcatttagtacacattcatctttttaaaatgtgcagtttttgtcacagaagtagtgtaaaggacaccagaatggttggaagacgatttttgtggtcttctacaagtcctgt

SEQ ID NO: 1005 - DNA, 401 bp, Homo sapiens
ccctgggttccagtgattctccagcctcagcctcctgattagctgggattacagacacccgccatgacaccctgctaatttttgtaattttagtagagacagggtttcaacatattggtcaggctggtctcgaactcctgacctcaggtgatccacccaccttggtctytcaaagtgctgggattacaggtgtgagccacygtgcccggcccttggcctttattcyttattttccctgatattaatccctaatgaaatgcatttagtacacattcatctttttaaaatgtgcagtttttgtcacagaagtagtgtaaaggacaccagaatggttggaagacgatttttgtggtcttctacaagtcctgttttggtgactctgagcaagtcttaaccttgcc

SEQ ID NO: 1006 - DNA, 401 bp, Homo sapiens
ctcagcctcctgattagctgggattacagacacccgccatgacaccctgctaatttttgtaattttagtagagacagggtttcaacatattggtcaggctggtctcgaactcctgacctcaggtgatccacccaccttggtctytcaaagtgctgggattacaggtgtgagccacygtgcccggcccttggcctttattcyttattttccctgatattaatccctaatgaaatgcatttagtacacattcatctttttaaaatgtgcagtttttgtcacagaagtagtgtaaaggacaccagaatggttggaagacgatttttgtggtcttctacaagtcctgttttggtgactctgagcaagtcttaaccttgcctacatttcctcacatttagggcaag

SEQ ID NO: 1007 - DNA, 401 bp, Homo sapiens
accagaatggttggaagacgatttttgtggtcttctacaagtcctgttttggtgactctgagcaagtcttaaccttgcctacatttcctcacatttagggcaagtgtactcttcagggtcaactgcaatatctgtgggagtgctttgtgttttgtagcatgcatcttactagtgcttttgttgttgtttgcgttgtcgtgygggttccccacctcccccataacactgtaaagaaatgctgagactaagtggtagggagtggcagccatctggtgaggatggaaagttaatatctttatttatgtaataaacctccctttagaattctgttactgtcaaatttctcctggaattctaatagtattttcgctatgtgttttgaccttttgctattgggaaga

SEQ ID NO: 1008 - DNA, 401 bp, Homo sapiens
ttatgatttccgcagacttaaatcaaccctgggcttctatccttatactagttttattttatgttttttgtttgtctttagagaaatgatcgtgttctgtcatccaggctggagtgcagggacataatcacagctcactgcagcctcaaactcctgggctccattgatcttcctgcttcaacctgctgagtagctaggacyacaggcacgcaccatcaggcccaactacatttttaaatttttttctagagacgatgtctcgccatgtttcccaagctggtcttgaaccctggcctcaagcaatcctcccacctcagcttccctaagtaccaggattacaggcataagccactgagcccagccccacccttacatgttttctcttggcatcctgatccctg

SEQ ID NO: 1009 - DNA, 401 bp, Homo sapiens
gtttcccaagctggtcttgaaccctggcctcaagcaatcctcccacctcagcttccctaagtaccaggattacaggcataagccactgagcccagccccacccttacatgttttctcttggcatcctgatccctggacacaaccccattgagatacccttccatttaatacttttcttagtcatttaccaaatgtgtttayagtaatatattcccatatatttgtggcagagtacagcactcatataaattttgatgaacacagacatgctgtcccatacttgtaggtaaaacaatcatgtgaaattaaaataaatattttgtttagatagatcttgactatcatacacttattctaacaatattgcccattcctcaaaacattctgggaactccttgaaa

SEQ ID NO: 1010 - DNA, 401 bp, Homo sapiens
gtttatttatgcaaagcacataggatcataggattgctctctaggagaatggagtaattaataccatgaagactcatagacaatgcttcctcccctagaaactcattatttttcgaattttggcactgatctttcctgcctacttcctggcttttactaccttgtgaaaaagccccaagtgttagaagcagcttccccagyttactgccatcccttctaaggtccctggacaccactgcttgtctcctaccttagaaagtgcctacttggccaggcacgctggctcacgcctgtaatcctagaactttgggaggctgaggcaggaggatcacgaggtcaagagatcgagaccatcctggccaacatggtgaaaccccarctctactaaaaatacaaaaatt

SEQ ID NO: 1011 - DNA, 401 bp, Homo sapiens
gtgttagaagcagcttccccagyttactgccatcccttctaaggtccctggacaccactgcttgtctcctaccttagaaagtgcctacttggccaggcacgctggctcacgcctgtaatcctagaactttgggaggctgaggcaggaggatcacgaggtcaagagatcgagaccatcctggccaacatggtgaaaccccarctctactaaaaatacaaaaattagctgggtgtggtggggcatgcctgtagtctcagctacttgggaggctgaggtaggagattcacttgaagccgggaggtggaggttgcagtgacctgagatcacgccactgcactccagcctggtgacagagagagactctgtctcaaaaaaaaaaaaaaaaaaaaaaaaagtgccta

SEQ ID NO: 1012 - DNA, 401 bp, Homo sapiens
gggtagagaaagtattacatatctgcatgtgtggatgtgaaggacacacagatacataaggtaaatgagaatttattataaaggtgtatttgacaaaaattggggaaaaaaggaaaattggagaagatatctttctgtgagattaaagacaaataggggaaaaaagggaccaatgacaagaattagagcaaggtatgtaawgaattccagagctggctctaagagatagagcagctggtcatatrtgaaagggatgattcattcttcaggggctatccctcgtgatcctatttccttgcacaagctatcagttaatttattgattcacctcctttatgtgctcataggcatcaagaatacaatggatcacatacaattacagaaaagtttcatttcaggag

SEQ ID NO: 1013 - DNA, 401 bp, Homo sapiens
cacacagatacataaggtaaatgagaatttattataaaggtgtatttgacaaaaattggggaaaaaaggaaaattggagaagatatctttctgtgagattaaagacaaataggggaaaaaagggaccaatgacaagaattagagcaaggtatgtaawgaattccagagctggctctaagagatagagcagctggtcatatrtgaaagggatgattcattcttcaggggctatccctcgtgatcctatttccttgcacaagctatcagttaatttattgattcacctcctttatgtgctcataggcatcaagaatacaatggatcacatacaattacagaaaagtttcatttcaggaggtcaaacaggaagtttctttctgacttatattgaagtactcatg

SEQ ID NO: 1014 - DNA, 401 bp, Homo sapiens
ttcatttcaggaggtcaaacaggaagtttctttctgacttatattgaagtactcatgatgacaatggagaaaaatgaacataatcttttatgggtggggaccatgtgatctcttttctttcaagctccagagggtttataagacatttccatgttcaatttgattccggaaattatatgttgggtagaacagactcttttyggcaactcatgagaattgccaatgatcccagcatttgctactcttgatagtaattcccttcatttcctccatttttatacatgacctgcagtaaatattgacagttactttgctggaaagaataacacagagacagcttttcttaagctccaaactgaatttcgtggttaattgattggccagctggccctgccgtctct

SEQ ID NO: 1015 - DNA, 401 bp, Homo sapiens
tgggaggcagcaaatgcccaaatggaagacaatgtatgtagatcaaagaagccgatgagacagagagttcataaaatgtgaatacaattccaggggagaattgatgattatggaagcagaaagccaattgagttaaatattcattccagcaacaagtctgatcgtctcactgggacctgtgcctttccgaagtttcctcakcttttcaaggtctacacaaggaaagaacaaagccatcaaggaggctctcattctggaaagccggctgcaagatggcatgaaccagaggtcagcggccaccactgagagttcatcgtattcgcctctgtaaagaataagcctcaagcagtggttctgcaggagcggttcagcatcatcaataccaatgagccctaatgaat

SEQ ID NO: 1016 - DNA, 401 bp, Homo sapiens
aagaatttgtcagggtcccagtccctgtaccttatgggagaattaaattcattaaactgggccagatgtggtggctcacactggtaatctcagcactttgggaggctgaggcaggtggatcacctgaggtcaggagcttgagaccagcctggccaacatggtgaaaccccatctctactaaaaataaaaaaaattagtcargcttggtggtaggtgcctgtaatcccagctagtcaggaggctgaggcaggagagtcgcttgaacctgggaggcagaggttgcagtgagccgagatcgtaccactgcactctagcctgggcgacagaatgagactcagtctccaaaaaataaataaataaattcattaaactgaacaaattgagcccaatttatttgtcat

SEQ ID NO: 1017 - DNA, 401 bp, Homo sapiens
ataatttattctcattattttttgtttgttttttgagacagagccctgctctgtcatcagtctggagtacagtggcgcgatctcagctcactgcaatccctgcctcctgggttcaagtgattcccctgcctcagcctcccgagtagctgggactacaggcatgcatcaccatgcccagctaattttttctattttggcagrgatagggtttcaccaggttggccaggatggtctcaatctcctgaccttgtgatgtacccrccttggcctcccaaagcgctgggattacaggtgtgagccaccacgcccagcccattcttgtttcttggtaaaggaaaatccaactatatatatcttctttaggatcacytaaagacccatacagatctgtcaaatagaca

SEQ ID NO: 1018 - DNA, 401 bp, Homo sapiens
tctggagtacagtggcgcgatctcagctcactgcaatccctgcctcctgggttcaagtgattcccctgcctcagcctcccgagtagctgggactacaggcatgcatcaccatgcccagctaattttttctattttggcagrgatagggtttcaccaggttggccaggatggtctcaatctcctgaccttgtgatgtacccrccttggcctcccaaagcgctgggattacaggtgtgagccaccacgcccagcccattcttgtttcttggtaaaggaaaatccaactatatatatcttctttaggatcacytaaagacccatacagatctgtcaaatagacatccaatattttggtaggctttgaaaggaggtgcaaaaggatgagaaggaatttagggaga

SEQ ID NO: 1019 - DNA, 401 bp, Homo sapiens
catgcccagctaattttttctattttggcagrgatagggtttcaccaggttggccaggatggtctcaatctcctgaccttgtgatgtacccrccttggcctcccaaagcgctgggattacaggtgtgagccaccacgcccagcccattcttgtttcttggtaaaggaaaatccaactatatatatcttctttaggatcacytaaagacccatacagatctgtcaaatagacatccaatattttggtaggctttgaaaggaggtgcaaaaggatgagaaggaatttagggagatcattatctgaatcattgaacaaatgctccttaagcacctggtgaagagaggctactgagaagcagagcacgtggtcccagcctacgaggtgacaaagtaaaatggcag

SEQ ID NO: 1020 - DNA, 401 bp, Homo sapiens
gtcaaaggatccaaagtttcagttagacagaaaaaataaacttcagtgatctattgcacagcatggtgaccacagttaaaaataatgtatggtacatctccaaattgcttaaaaaaaaaaaaaaggtttcaaatgttgtcaccacagaaaaacaaaaacaaaaacaaaaaaaacaaaaaaaacgaggcaaggtgatggagwtgttaattagcttgatttaaccttcctacaatgtatatgtgttagtccgtttttgcgttgctgtaaagaagtatctgaggctaggtaatttgtaaagaaaagtggcttattttggctcatggttctgtagactataaaggtagcgtggtgctagcatctgcttttggtgagggctcagaaagcttccartcatggcagaa

SEQ ID NO: 1021 - DNA, 401 bp, Homo sapiens
aggtgatggagwtgttaattagcttgatttaaccttcctacaatgtatatgtgttagtccgtttttgcgttgctgtaaagaagtatctgaggctaggtaatttgtaaagaaaagtggcttattttggctcatggttctgtagactataaaggtagcgtggtgctagcatctgcttttggtgagggctcagaaagcttccartcatggcagaaggcaaagggggagcccacatatcagatggtgagagggagcaagagttgagggggaggtgccacrctcttttaaacaaccagatctcatatgaactcagagcaagaactcactcattatcgtgagaacaacaccacgctattcacaagggatccacccccatgaccaaaacacctcccactgggccccac

SEQ ID NO: 1022 - DNA, 401 bp, Homo sapiens
taaagaagtatctgaggctaggtaatttgtaaagaaaagtggcttattttggctcatggttctgtagactataaaggtagcgtggtgctagcatctgcttttggtgagggctcagaaagcttccartcatggcagaaggcaaagggggagcccacatatcagatggtgagagggagcaagagttgagggggaggtgccacrctcttttaaacaaccagatctcatatgaactcagagcaagaactcactcattatcgtgagaacaacaccacgctattcacaagggatccacccccatgaccaaaacacctcccactgggccccacttccaacactgcgggttacatttcaacatgagatttaaaaccatgtcagtatacatacatacattaaaatatgca

SEQ ID NO: 1023 - DNA, 401 bp, Homo sapiens
catacatacattaaaatatgcatcacattgtgccctatacacatataaattattgtttgtcaattaaagaaagaaataattttaaaataaataggccaggcgcagtggctgatgcctataatccaagcactttgggaggccaaggcaggcagattccttgagcccaggagttcaagagcagcctgggcaacatgatgaaayctcatctctaaaaaaatacaaaaattagctgggtatgtggggggtgcacaggtagtcccagctactcaagaggctgaggtggggggattgcttgagcctggcaggcggaggttgcagtgagattgcaccactgcacaccagcctgggtaacccattgagaacctgtcttaataaataaataaataaataaacaaacaaat

SEQ ID NO: 1024 - DNA, 401 bp, Homo sapiens
catagttgaagttgacattaactagcatgtgccaacgagtgacaaaggaaacaagtgcaaagcaagaaaagttagccattatcatggtccatagataatactctcaaccccggctcttgagtgaagcagtattgtgcagtggttacatttatggacctaatggtcaaactgcatgagttcaaatcccagctttacagctawtggttgcattatcttgggcaagtcatttaacatctctgccttaattgattcacctctratatagagctgataggagtctgaaatagctgctataaggactaaatacattaatatatagatagcattcataacagtgttttgtggactttccgaaggtgctgggccttccagttgccttaaagaatggattggattagggt

SEQ ID NO: 1025 - DNA, 401 bp, Homo sapiens
aaagcaagaaaagttagccattatcatggtccatagataatactctcaaccccggctcttgagtgaagcagtattgtgcagtggttacatttatggacctaatggtcaaactgcatgagttcaaatcccagctttacagctawtggttgcattatcttgggcaagtcatttaacatctctgccttaattgattcacctctratatagagctgataggagtctgaaatagctgctataaggactaaatacattaatatatagatagcattcataacagtgttttgtggactttccgaaggtgctgggccttccagttgccttaaagaatggattggattagggtggaggagatgaaaaaaggcatcacagtacatcaagtgmatggtgccagtgtaagtaga

SEQ ID NO: 1026 - DNA, 401 bp, Homo sapiens
gccttaattgattcacctctratatagagctgataggagtctgaaatagctgctataaggactaaatacattaatatatagatagcattcataacagtgttttgtggactttccgaaggtgctgggccttccagttgccttaaagaatggattggattagggtggaggagatgaaaaaaggcatcacagtacatcaagtgmatggtgccagtgtaagtagaatacaggaataaggaaatgcccagcttgttggggggttagtatgaagacctctaactgggactgaaagttctagcaacagtaaaataccctggcctccaactactaagtaccctgaatactaagatgagtttatttttcattctatagacaatttccatctctttctttcaaaacaaaca

SEQ ID NO: 1027 - DNA, 401 bp, Homo sapiens
gtgtaagtagaatacaggaataaggaaatgcccagcttgttggggggttagtatgaagacctctaactgggactgaaagttctagcaacagtaaaataccctggcctccaactactaagtaccctgaatactaagatgagtttatttttcattctatagacaatttccatctctttctttcaaaacaaacaaatgatgacrctgtatgagtaacagaagatgactgggaacagaaccgtgaacagaattaagcacctgcaatcaaataaaattcacagaaaacttaatttaccacattagtgatatgcataatcgttgttgtrctggtaaccagctcttcaggaaaaaaaaaagaaaattcctgatttgttaaaatactgtcactatggcccactgaaact

SEQ ID NO: 1028 - DNA, 401 bp, Homo sapiens
cctgaatactaagatgagtttatttttcattctatagacaatttccatctctttctttcaaaacaaacaaatgatgacrctgtatgagtaacagaagatgactgggaacagaaccgtgaacagaattaagcacctgcaatcaaataaaattcacagaaaacttaatttaccacattagtgatatgcataatcgttgttgtrctggtaaccagctcttcaggaaaaaaaaaagaaaattcctgatttgttaaaatactgtcactatggcccactgaaactatcaaaatgaggcatataacaggaaattgggaggagagttatacaatcagctcttgctagaaaatgatgatcattgacattacccttatggaaccaatccaaatttgggsgttgttttcttt

SEQ ID NO: 1029 - DNA, 401 bp, Homo sapiens
aatcgttgttgtrctggtaaccagctcttcaggaaaaaaaaaagaaaattcctgatttgttaaaatactgtcactatggcccactgaaactatcaaaatgaggcatataacaggaaattgggaggagagttatacaatcagctcttgctagaaaatgatgatcattgacattacccttatggaaccaatccaaatttgggsgttgttttctttctttctacttttgtgtgtgtgtgtgtgtgtgtgtgtgttctctggtatctgtaaataacatccatatcagtttctccatccattctttgcacatcactggtaatgcctgagatcaaatctgccatgcttttccgggcagatccaggctgggatctcagtatccctgcttccctgaagctgtccaacct

SEQ ID NO: 1030 - DNA, 401 bp, Homo sapiens
gtccaacctcactcccttcattgctctgctgtgattaggaaggagccattccaaggactatggggtgctctgtgggataagcccagtccttcttccatacaggaggaacaggggacgggtgctgacaagaggaaatgcatggagcagagagagggaacaggcagatggactcaaggtccccagactctttcgagtgttgartcagaaggactggagctgtgggggaagagggtgggaacagggtagtggaataacatgcagacagatgggctgaactgaaggtccagaggcactcccagccgtcaaccagcagttcttacaccaggttgatgttagggaacaaccccagctttaaaacttatttataccaaagtgccaaatgactcatttgagacaaggct

SEQ ID NO: 1031 - DNA, 401 bp, Homo sapiens
aagttatgcatttagttgcctcttgttcattagtctggacttagagcaaagtgactacttcaacttcttgtgctcaacatatgccacagttgcttacatgtgataagtccatttgtcacttgataagcctttgctagaatttccttctctccatctccaaccttataatgatcttgaaggcaatgtcggaggctaggtaartcttctttgtgttccccacttgagcataggtgagctgtcatgtcaatttccttacactactgagaagaggggatgtgggtgggcagggacccccagaaacaactttacccctttcacagtttccatcactgcctccaatgtccaccgacgttagaaagtttgggcagaagtggccaggtgcggtggctcacgcctgtaat

SEQ ID NO: 1032 - DNA, 401 bp, Homo sapiens
ccctttcacagtttccatcactgcctccaatgtccaccgacgttagaaagtttgggcagaagtggccaggtgcggtggctcacgcctgtaatcccagcactttggggggccgaggcgggcagatcacaagctcaggagatcgagaccatcctggctaacatggtgaaaacccgtctctactaaaaatacaaaaattagccrggcgtggtgtcaggcgcctgcagtcccagctactagggaggctgaggcagaagaatggcatgaacccaggaggcggagcttgcagtgagccaagatcgcaccactgcactccagcctgggcgacagagcaagactccgtatcaaaaaaaaaaaaaagaaagtttgggcaaaacctagagtttcagggaaagtcatttgag

SEQ ID NO: 1033 - DNA, 401 bp, Homo sapiens
aaaacatgagagaagggagtcaactttgacagagatttcaagagcagatcactgatgaaatgtgataacattcagaaaatagagaagttgacatgggctttgatgaaaacacaatgagttcagtttgaagcattttgaagtcaaggtgattttgtgaaatacaaacgatgctgtccagcaggcatagaatctatctggagycatttgtacaatatacctatgccttttttttttctttctcctactgtagacttagataggaactcacttttgtcttttttctgctaggccaataaatacgttctcagcttagaaaaggggctttttggtttgcctatttctgtttctttttacagaagttaacacatttatttgtgacctattaaaatcatgaagtatta

SEQ ID NO: 1034 - DNA, 401 bp, Homo sapiens
attcttgtgcaaagaaggattccaaagggtttcagaaatactaaacttcttgaaattgaaattgaaattgaaatccttcttggcttctctacctgttacttcctctgcagtgctcagtatagtgtctgctctccctcctttctttttctttttttttgagacagattttcactcttgttgcctaggctggagtgtaatggygcaatcttggctcaccgcaacctctgcctcttgggttcaagcgatactcctgcctcagcctcccaaggagctgggattatagtaccacgcccagctaattttgtcttttcagtagagatggggtttctccatgttggtcaggctggtctccaactcctgacctctggtgatcctccctcctcggcctcccaaagtgctgg

SEQ ID NO: 1035 - DNA, 401 bp, Homo sapiens
tcaaacccctaaagttatccttgaataaatgagccttgcaaattatatttccccaatttgcacttatttctttcttttttttcttttttctttgagacagagtttcactcttattgcccaggttggagtgcaatggagtgatctcagctcactgcaacctccgcctcctgggtttaagcaattctcctgcctcagcctccyragtagctgggattacaggcgctccccccctccccatgcctggctaattttttatatttttagtagacagggttttgccgtgttggccaggctggtctcaaactcctgacctcaagggatctgcccacttcggcctcccaaagtgctgggattacagatgtgagccaccgcacccagcctcagaatttcttactgaataa

SEQ ID NO: 1036 - DNA, 401 bp, Homo sapiens
caaacccctaaagttatccttgaataaatgagccttgcaaattatatttccccaatttgcacttatttctttcttttttttcttttttctttgagacagagtttcactcttattgcccaggttggagtgcaatggagtgatctcagctcactgcaacctccgcctcctgggtttaagcaattctcctgcctcagcctccyragtagctgggattacaggcgctccccccctccccatgcctggctaattttttatatttttagtagacagggttttgccgtgttggccaggctggtctcaaactcctgacctcaagggatctgcccacttcggcctcccaaagtgctgggattacagatgtgagccaccgcacccagcctcagaatttcttactgaataat

SEQ ID NO: 1037 - DNA, 401 bp, Homo sapiens
cccctccccatgcctggctaattttttatatttttagtagacagggttttgccgtgttggccaggctggtctcaaactcctgacctcaagggatctgcccacttcggcctcccaaagtgctgggattacagatgtgagccaccgcacccagcctcagaatttcttactgaataatccttttatagtttgttataactaacwcaaaacagtagtgggagttcttattcagatagctaamaaattccaggcacctcctgtactataagtgtccctcatagcacaaaggggaaagctgccctttaagaatccataaatgcaatgaaactctacttacgccacccaggttgttaggacacaggaatattaatctggagaagcctttgataatagaatatagtcaa

SEQ ID NO: 1038 - DNA, 401 bp, Homo sapiens
tagacagggttttgccgtgttggccaggctggtctcaaactcctgacctcaagggatctgcccacttcggcctcccaaagtgctgggattacagatgtgagccaccgcacccagcctcagaatttcttactgaataatccttttatagtttgttataactaacwcaaaacagtagtgggagttcttattcagatagctaamaaattccaggcacctcctgtactataagtgtccctcatagcacaaaggggaaagctgccctttaagaatccataaatgcaatgaaactctacttacgccacccaggttgttaggacacaggaatattaatctggagaagcctttgataatagaatatagtcaaagttgacattgtgctagaatatttgaattttttattt

SEQ ID NO: 1039 - DNA, 401 bp, Homo sapiens
attgtgctagaatatttgaattttttattttccagaaattattttcactctttgctacatttactgtttgacctcaaaagaatgtaaaagcaagtttttaaatacaccattatttcctcaagaggctacagaattgctggatttttttttttttttggaatggagtcttgctctgccacccaggctggagtgcagtggcaygaccttggcacactgcaacctccacctcctgggttcaagcagttctcttacctcagcctcctgagtagctgagattacaggtgtgtgctcccatgcctggctaatttttgtatttttagtagaggtggggtttcgccatgttggccaggctggtctcaaattcctgacctcaagcaattcacttgccacagcctcccaaa

SEQ ID NO: 1040 - DNA, 401 bp, Homo sapiens
gtacatttttgtcaaatgaacctaattggcaaagcaaaatctcatcttttaaatttctgagtttccactattgataaaaaaaaaaaaaataacgtaaaacagtgttggattttcaaactcaaaagaaagaaaaaaaccacaaaaaacaaaaaaagcagaagttgggtaaaaacgagttctgactaaaagctgcaatactgyctcaaatgtgcccrtgaccccacctattgctcaatttctacaccatgagggtaaagggaaacgaaatgcaacttggattcacttgacttcttaagtcttacagagagagaaactgatcagaaaagatacatttttggaggttggtttttttttttaattcttgcttgtaaggcagggcttggtgactcctggtctcctcc

SEQ ID NO: 1041 - DNA, 401 bp, Homo sapiens
aatgaacctaattggcaaagcaaaatctcatcttttaaatttctgagtttccactattgataaaaaaaaaaaaaataacgtaaaacagtgttggattttcaaactcaaaagaaagaaaaaaaccacaaaaaacaaaaaaagcagaagttgggtaaaaacgagttctgactaaaagctgcaatactgyctcaaatgtgcccrtgaccccacctattgctcaatttctacaccatgagggtaaagggaaacgaaatgcaacttggattcacttgacttcttaagtcttacagagagagaaactgatcagaaaagatacatttttggaggttggtttttttttttaattcttgcttgtaaggcagggcttggtgactcctggtctcctccaatagcctaatttt

SEQ ID NO: 1042 - DNA, 401 bp, Homo sapiens
aattcttgcttgtaaggcagggcttggtgactcctggtctcctccaatagcctaattttcctcccaaaagtaagcttttgattccactagggtgggcaagtatctttgtactctgccatttcagagataagagccaactgattttagaaatccaagagcaaatgaaatgtgcaacattttactcttggattgcttgagacygcatctgtatgcctattccctggagtgcagactgtcttgtgagcatttggtgccactgaactctgaaaatcagggcatgcagcatctgctggggaacacaatctggtttctgtggatcagaagcatttctctacacgttagagtcttaaggatttttaaagagagcaggtctactcaggcaactcgttaccgtccctttc

SEQ ID NO: 1043 - DNA, 401 bp, Homo sapiens
ccttcagtcattagtgacagatctattttaaagggacgaggttgtgcaacaagggtacaaaggcagctcatggttctaattgttgggctccattagaaggggtctttctggagactgtggtttcttagagcaccgcagtctacccctgaatgaaaggcatcctgctggctaattaacttgcagcactttcttctctattgkgccttgattttttgttttgtttggttttaatctcagaccttgtttctagtaggactgatggagtcttccattatttcgccyaaatattttatgaagaacaragtttccaatcactcactcactctgatttcattacttttagcatacttttcgttcttataatctgcaataaagaggaagactattaagattcaagcttg

SEQ ID NO: 1044 - DNA, 401 bp, Homo sapiens
gttgggctccattagaaggggtctttctggagactgtggtttcttagagcaccgcagtctacccctgaatgaaaggcatcctgctggctaattaacttgcagcactttcttctctattgkgccttgattttttgttttgtttggttttaatctcagaccttgtttctagtaggactgatggagtcttccattatttcgccyaaatattttatgaagaacaragtttccaatcactcactcactctgatttcattacttttagcatacttttcgttcttataatctgcaataaagaggaagactattaagattcaagcttgtttgagcaagtacactgccagagcaaaatcagaggaattcatggaagactgggaaggtgcaagtaatctttctcttagaat

SEQ ID NO: 1045 - DNA, 401 bp, Homo sapiens
gtctttctggagactgtggtttcttagagcaccgcagtctacccctgaatgaaaggcatcctgctggctaattaacttgcagcactttcttctctattgkgccttgattttttgttttgtttggttttaatctcagaccttgtttctagtaggactgatggagtcttccattatttcgccyaaatattttatgaagaacaragtttccaatcactcactcactctgatttcattacttttagcatacttttcgttcttataatctgcaataaagaggaagactattaagattcaagcttgtttgagcaagtacactgccagagcaaaatcagaggaattcatggaagactgggaaggtgcaagtaatctttctcttagaattgtgatggtaacatatgaaa

SEQ ID NO: 1046 - DNA, 401 bp, Homo sapiens
cagcttgggcaacatggcaaaaccccatctctacccaaacaaacaaacaaacaaacaaacaaactagccaggcatggtggcaactgcttgtagtctagctacagcttccatgaattgttcagtgatgctctcttaactccatgatctatggaacaggcaggcagaaatggagagacagtgggtggaggggaggagcctcaratggcacagaaatctgtagcatctagatcagagtgacacctcagagtttcgagtaacgacaggcacctggcccatggctgggattgttaccagtggtgaatctgtgcaggtctgcagcaacctcaattcttccctcyttaggataaaaacttcattgaggggcataaagcagaagagactgaagcaagttttagagaggg

SEQ ID NO: 1047 - DNA, 401 bp, Homo sapiens
tccatgatctatggaacaggcaggcagaaatggagagacagtgggtggaggggaggagcctcaratggcacagaaatctgtagcatctagatcagagtgacacctcagagtttcgagtaacgacaggcacctggcccatggctgggattgttaccagtggtgaatctgtgcaggtctgcagcaacctcaattcttccctcyttaggataaaaacttcattgaggggcataaagcagaagagactgaagcaagttttagagagggagtgaaagtttattaaaaagctttagagcaggaatgaaaagaaagtaaaatacacttggaagagggccaagcagacatcttggaggtcaagcacagggatttgaccttctgacttgggggtgtatatgctggcctat

SEQ ID NO: 1048 - DNA, 401 bp, Homo sapiens
gaatgaaaagaaagtaaaatacacttggaagagggccaagcagacatcttggaggtcaagcacagggatttgaccttctgacttgggggtgtatatgctggcctatttccagcacttcacatcccttttcccttgattcttcctttaggatgggctgccgcatgtgtggtggcctgctagtgcttgggaagtgagcatgcrcagtgtgtttactggcgttgtacacatgctcacctgaggcgttcttcgggtgaatgcccccagaaagtcatgtaccagttaaactctgccatttggcctcttagtgcatatgtgtgagccccctgcscaactcctgggaccttatcgggaagctgataatcaccagtttcagatttttcctatttataaaaagactgcct

SEQ ID NO: 1049 - DNA, 401 bp, Homo sapiens
ttcccttgattcttcctttaggatgggctgccgcatgtgtggtggcctgctagtgcttgggaagtgagcatgcrcagtgtgtttactggcgttgtacacatgctcacctgaggcgttcttcgggtgaatgcccccagaaagtcatgtaccagttaaactctgccatttggcctcttagtgcatatgtgtgagccccctgcscaactcctgggaccttatcgggaagctgataatcaccagtttcagatttttcctatttataaaaagactgcctttccctggagctggctgcaaccaattattttagagagacagttaccaaccacctgttcatcacttgatggtggcctgacattcctggttagggcggggggcactgtcctgctctgctcatgtctgcc

SEQ ID NO: 1050 - DNA, 401 bp, Homo sapiens
ctgtcctgctctgctcatgtctgcctacctactgtagcaggaccacaggcagacttttcttaaggagactcccagctttcttcctggtgaaggacccagagtttgtgagcccaggactgcagataatcaaaaatattaaattatggaagctaaatatttaaaataataactcataatggctctccaaatgtctgtaaaagsatttcacttaacaatasctggcaaatattatgtcagtggaaaatacagccaagttttggctcatccaaaatgttgtcatcaccgccactttaatatttaagagattaatgtttcaaggctcttccagaacattgtatttggagtctgattgaaagactcctcggtcctccctcattattctttatgtgtgactttggatg

SEQ ID NO: 1051 - DNA, 401 bp, Homo sapiens
tgtctgcctacctactgtagcaggaccacaggcagacttttcttaaggagactcccagctttcttcctggtgaaggacccagagtttgtgagcccaggactgcagataatcaaaaatattaaattatggaagctaaatatttaaaataataactcataatggctctccaaatgtctgtaaaagsatttcacttaacaatasctggcaaatattatgtcagtggaaaatacagccaagttttggctcatccaaaatgttgtcatcaccgccactttaatatttaagagattaatgtttcaaggctcttccagaacattgtatttggagtctgattgaaagactcctcggtcctccctcattattctttatgtgtgactttggatgctctcaatacacttaaa

SEQ ID NO: 1052 - DNA, 401 bp, Homo sapiens
ttgtattttaacaaggcctccatgcaattctgatgtgccctccagttttagaattgatgctctgtgcaaatgaacaggtactggggcataatgatatgcaggactgttcttgagccaggctttgtattcatgaagtgggtgatagttgattggcattgtttcagtactcagtagctatgaagcattctattggtatcattrgtattaaatatggagcagaagcataactcatctccctcatggccacatgaagaaagatcagtatgttagagctgaaggacacctaaagccccaaacaactgccagagaccaaaatcatttgtctcaagaaatgttaacaccctttttgtgttcaagttttattatttctttactaaaattgcccattcacccctttgttt

SEQ ID NO: 1053 - DNA, 401 bp, Homo sapiens
attatttctttactaaaattgcccattcacccctttgttttatttttcacacctaaaaaagtagccaagtttgaaaaagaaagagtgcttgccaccctttctgtccttaaagtgaaggccttgtctatctcattctgatctctgcccatccatcaccattcagcactcctgttgtgacttcgccccatctccaatcttacrttttattttcttggtacttttggtcatggctgtgttgatggtttcagaagaatacatagtatattaaggggtaacgtttacaaatgttcttgagagaactaatttttcccccttcatctcaaggtgtcactgcttaattattacggttcctaaataatctctatgatgtggttaactatccctaccttgcagaaatcctg

SEQ ID NO: 1054 - DNA, 401 bp, Homo sapiens
cttaattattacggttcctaaataatctctatgatgtggttaactatccctaccttgcagaaatcctggaagatgagacggacctagcatgttgtgtgagcaacatctcttagagataatcaatttgatatcagcacaattattgtggctactattgaaatttctcttagtttcttagattagtactattggaactaatcrtaaataaccaatttacaagaaaatgagtctcattatattatagcacgaagaggatatattcaaggagatacacctttgaatctattatttcratatgcttataaaaattactattttaataaatttcccagtcaatcctattgtgtagaaaaagatgcttcactgcttacatattttaagatgagactgggaacaagcag

SEQ ID NO: 1055 - DNA, 401 bp, Homo sapiens
tgtgtgagcaacatctcttagagataatcaatttgatatcagcacaattattgtggctactattgaaatttctcttagtttcttagattagtactattggaactaatcrtaaataaccaatttacaagaaaatgagtctcattatattatagcacgaagaggatatattcaaggagatacacctttgaatctattatttcratatgcttataaaaattactattttaataaatttcccagtcaatcctattgtgtagaaaaagatgcttcactgcttacatattttaagatgagactgggaacaagcagattaatttggttgtgagactgggagtttatgagcaaaatgttcttctgtgcaaacgaagtagaagcttcatttcccttcccttcagttaacc

SEQ ID NO: 1056 - DNA, 401 bp, Homo sapiens
aaaactagactaaattctgtattgaaaatgtcaagtcaaatatgctatataaccaagaaatatcagtatagaatatcatgtattctacacaaagctacattttcaatataatccccgtaattatttcactcatcaaagaaatgtatccagctgagacataaaaccttagtcaatacattaagaaaaaaagaaaaaaaaaamcatttttttcccagtcatggggaccagattgtgtctattattcatcagggcctagcacaatgttgagcacatgctcaaggtggccaataaatccttgtggaattgagttatatgggagtcaattattcggtcacagcactggattaggaggttgagttcttgatagatttactttcagctgacctgtgtgacatttggta

SEQ ID NO: 1057 - DNA, 401 bp, Homo sapiens
catttggtatttggttttgcaactttgttttcagttttttccatgcaccaatactcctagaattttgcttttgcctcttttcttccctttcatcttttttttttttctgtagaaagcatacatccatatagaagacctctctcaatacattccagatctgagttgcagtgcagcacttagcttagcttgtgaaacactccraagacttgattaatatcatcctatggagagatgtccttaagtaacttagaatggatcctttatttttccagtaaataaactctaaaatatgaggatttccaaggtgaaaagaaagagtacgaacccaagaaatattttaaatgaatcttgttttccgtccctgtgttctgagtaacatctgtattcacccctgcctttcc

SEQ ID NO: 1058 - DNA, 401 bp, Homo sapiens
atatttgtcgttgaattatttcttctttgtttaaaattaaataatgcaagtgatttttttgctttagaaaggaggattacctcttcctagacatccagttgaaaaaccaactggtatagaagggaaatgcatctcaaacagatacaatgacattcttataattgcctcatttgaaatggcagcatttccccgtgctaattrtcatccttcagctaatttggtacattaaaggagattgttattaaaaacaaaattaaatccattgccagcatctttattctctaccagaagaaaaattttaaataaatgcaaatacgccagttttgctcttaatgttgcctgaagttgaaaggatgaactttgacttgaaagataatgagttccccctgttggaggatytg

SEQ ID NO: 1059 - DNA, 401 bp, Homo sapiens
ttrtcatccttcagctaatttggtacattaaaggagattgttattaaaaacaaaattaaatccattgccagcatctttattctctaccagaagaaaaattttaaataaatgcaaatacgccagttttgctcttaatgttgcctgaagttgaaaggatgaactttgacttgaaagataatgagttccccctgttggaggatytgaggtttgggttggataatcccagatgatgttggaatagacagaatttaaggttccttctaaccctgaaattctatggttataaaatctatccttttcttgaaagaagaaatattaaaggtgttttcaaggaaatggtagcataatgaaaaaggaaacacaaaaatgatttttttttccttaataagcagtcacctcac

SEQ ID NO: 1060 - DNA, 401 bp, Homo sapiens
tttttcttcttaattgcttgtttgtttgtaacaaatgcggtggtgtaatcaagtggcttttacaataataaaacacttctctcaattaaactgtactgcaaggaattcaaagatgaacagaagtgttccttcttttaagatgctgatttataagcatccctttaaaatttacttctctttctgatgataaaagtaatacaygtttattgtagaacatttggaaactaccagggactataaataacccatagttgccccaccagagaatattcttaatatttttggcatatttcttccatatatctattcatattcacattcatactaatttgtcatattctaatttaaccctctctttaatgtttataatgtgattatactactttttaacacatgaattg

SEQ ID NO: 1061 - DNA, 401 bp, Homo sapiens
ttgttgttgttgttttgagacagagtttcactcttgttgcccaggctgaagtgcagtggtgtgatctcggctcactgaaacctctgcctcccaggttgaagggattctcctgcctcaccctcccgagcagctgggattacaggcgctcgccaccacgcccagctaatttttatatttttagtagagatggggtttcgccaygttggccaggctggtctcgaaccctgacttcaggtgatccacccgcttcagcctcccaaagtgttgggattacaggagtgagccactgtgcccagcctgtttggttttgtttttgttattgtttgtttgtttggagtatgtctttattagcagtgtgagaacaaactaatacatcagaagttctgattttcatatcagca

SEQ ID NO: 1062 - DNA, 401 bp, Homo sapiens
aaagattcctccaggacttttacaaagacagatgatattaaactgaacaaatagtgctaggtaagaagtaaattgttcaattttttcacagaagccctgtagattttagcaaaaccccccagacacaatgtcaaatttctcagcaggtttcttggttttagctcttccccttaagcagtagttaacagaatattagatgtkagtaaagttatttctttgttattctacctgggttgactaccagagaaaatccctgaacattttacaaattgctcaacagattttcatctaaaactagaaaagattggccagttatggtggctcacgcaggaacattgctttagcccaggagctgaaaaccagcctgggcaatagagtgggacccccatttctaaaaaata

SEQ ID NO: 1063 - DNA, 401 bp, Homo sapiens
tgggttgactaccagagaaaatccctgaacattttacaaattgctcaacagattttcatctaaaactagaaaagattggccagttatggtggctcacgcaggaacattgctttagcccaggagctgaaaaccagcctgggcaatagagtgggacccccatttctaaaaaataatatcttttaaaaaattaactgggcatgkcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaattagaaaggataggtgtgtktgggagggagactggttaaycagggt

SEQ ID NO: 1064 - DNA, 401 bp, Homo sapiens
atcttttaaaaaattaactgggcatgkcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaattagaaaggataggtgtgtktgggagggagactggttaaycagggtgcatgggattatgtagggcttgtctttcatttgagttcttctctgtctttttaaaatgactgattatatatattaggtcccaatggcttcattatcactattattttaattcataggttaaattttataaacatgaaaaataattgacaagcctagaatctcttttctgtctat

SEQ ID NO: 1065 - DNA, 401 bp, Homo sapiens
ggcatgkcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaattagaaaggataggtgtgtktgggagggagactggttaaycagggtgcatgggattatgtagggcttgtctttcatttgagttcttctctgtctttttaaaatgactgattatatatattaggtcccaatggcttcattatcactattattttaattcataggttaaattttataaacatgaaaaataattgacaagcctagaatctcttttctgtctatattagaaattaaattatatt

SEQ ID NO: 1066 - DNA, 401 bp, Homo sapiens
tgcatgggattatgtagggcttgtctttcatttgagttcttctctgtctttttaaaatgactgattatatatattaggtcccaatggcttcattatcactattattttaattcataggttaaattttataaacatgaaaaataattgacaagcctagaatctcttttctgtctatattagaaattaaattatatttagtakttaagcaatacatgcatacatctcatgtaatccttactgtaattaaggatgaaattatgtaacataggaaaagcagatgtaagttctcattctccttttacacataaggaaattaattcagacttttagtaagttgcccagaatcacgcagctagtaagattcagaactaaaaatataatacctgtcttctaattcaaat

SEQ ID NO: 1067 - DNA, 401 bp, Homo sapiens
atctctaaaatgatacctaaaatgataaacaatttaaatttagcataattatcattttttaacttacagattgacatatttctgcaagtgttttcagaggcattggggccacagaagtccaagtcaaggcaatttttggtactaaacagttgacttttctctggtccacatcaaagctgccactgtgcagagaactaacaygtgtaygtgactagtctagggctggaggaacatgcgaggggactgttggaaaggaaaaacttttgctcttcctctaggttcagtaaattagggactgtaaacaataataatgaaagattaataagaggcacacaattttattttattttattttatttacttatttttttgagacagagtttcrctcttgttgcccaagc

SEQ ID NO: 1068 - DNA, 401 bp, Homo sapiens
aaaatgatacctaaaatgataaacaatttaaatttagcataattatcattttttaacttacagattgacatatttctgcaagtgttttcagaggcattggggccacagaagtccaagtcaaggcaatttttggtactaaacagttgacttttctctggtccacatcaaagctgccactgtgcagagaactaacaygtgtaygtgactagtctagggctggaggaacatgcgaggggactgttggaaaggaaaaacttttgctcttcctctaggttcagtaaattagggactgtaaacaataataatgaaagattaataagaggcacacaattttattttattttattttatttacttatttttttgagacagagtttcrctcttgttgcccaagctggggt

SEQ ID NO: 1069 - DNA, 401 bp, Homo sapiens
gtgcagagaactaacaygtgtaygtgactagtctagggctggaggaacatgcgaggggactgttggaaaggaaaaacttttgctcttcctctaggttcagtaaattagggactgtaaacaataataatgaaagattaataagaggcacacaattttattttattttattttatttacttatttttttgagacagagtttcrctcttgttgcccaagctggggtgcaatggcacgatctcggctcaccacaacctccccttcccgggttcaagtgattctcctgtctcagcctaccaagtagctgggattacagacatgcatgaccatgcccggctaattttgtagttttagtagagactgggtttctccatgttggtcagcctagtctcgaactcctgacc

SEQ ID NO: 1070 - DNA, 401 bp, Homo sapiens
cctccccttcccgggttcaagtgattctcctgtctcagcctaccaagtagctgggattacagacatgcatgaccatgcccggctaattttgtagttttagtagagactgggtttctccatgttggtcagcctagtctcgaactcctgacctcaggtcatccactcacctcggcctcccaaagtactgggattacaggtgtragccactgtgcccggccccacaattttattaatatttatatgcaaaagagcttgtagaaaatcagtgaaaatcaaagaagtggttagactagggggtttataaacccttcttaaccaaggaaagagggtttgggcatcaatgagtggcgaattgtggagaagtgactagaaaatgtatgagagaaactaatggaaggtat

SEQ ID NO: 1071 - DNA, 401 bp, Homo sapiens
agaaaaacaaagattaacagttggagcagactctaaagccagtttttgagtccagaaggcagttagttggcaagatttctaaatgttggattcaaggctgggtgcggtagctgacatctataatcccaacattttgggaggctcaagtgggagaattgctcgaggccaggagttcaagataaacccgggcaacacagtgtractccatctctaataaagtcatccaaatgtagttgtatgcacctgtggtaccaactactcaggaggctgaggtggacggattgcttgagcccaggaggtctaggctgcagtgagccatgatcacaccactgccctccagcctgggcgacagagtgagatcctgtcttaaaaataaataaataaataaataaatgttggat

SEQ ID NO: 1072 - DNA, 401 bp, Homo sapiens
gtggacggattgcttgagcccaggaggtctaggctgcagtgagccatgatcacaccactgccctccagcctgggcgacagagtgagatcctgtcttaaaaataaataaataaataaataaatgttggatgaagtgtctttagatggtggattgaggataacaggggcagtctcagtcacgtgcatttcccggagtttgaargaacatgttctggtgagcttcctgagtggtccaaactacggtagtgataattcctttgaagttaggttcagttgtccaacttcagcttccagggctccaagaaaagggcaattgtggttctcagtgatgccaagtcacaagggtgagagaagactggaaacattaattacaagatggcaggattcagtttataaaggggg

SEQ ID NO: 1073 - DNA, 401 bp, Homo sapiens
agcaatgtcagcagaagcctgtactccagagtacctgccaaggttttgttcatgaatctctaatatgctctttctttgctgaagatgaggcatgctggcctacagctgactgcgtgagccttcagaaaagcatcggcataaaacaataattatctgtgaatgacaatgacttaaaatggccatacctaaagatctgatgarwgttcattataagtcaattgataaagaaatttggtygtttctctgacatacaggattttaagataataatgtgataccaagacatctcatgaacagcaagggcaytgacagatttctaggaattttatatgatttctgaaaaatcaaaatcattatatccatacaaatataacccaggaatggttaaatatcttctcttt

SEQ ID NO: 1074 - DNA, 401 bp, Homo sapiens
gcaatgtcagcagaagcctgtactccagagtacctgccaaggttttgttcatgaatctctaatatgctctttctttgctgaagatgaggcatgctggcctacagctgactgcgtgagccttcagaaaagcatcggcataaaacaataattatctgtgaatgacaatgacttaaaatggccatacctaaagatctgatgarwgttcattataagtcaattgataaagaaatttggtygtttctctgacatacaggattttaagataataatgtgataccaagacatctcatgaacagcaagggcaytgacagatttctaggaattttatatgatttctgaaaaatcaaaatcattatatccatacaaatataacccaggaatggttaaatatcttctcttta

SEQ ID NO: 1075 - DNA, 401 bp, Homo sapiens
gccaaggttttgttcatgaatctctaatatgctctttctttgctgaagatgaggcatgctggcctacagctgactgcgtgagccttcagaaaagcatcggcataaaacaataattatctgtgaatgacaatgacttaaaatggccatacctaaagatctgatgarwgttcattataagtcaattgataaagaaatttggtygtttctctgacatacaggattttaagataataatgtgataccaagacatctcatgaacagcaagggcaytgacagatttctaggaattttatatgatttctgaaaaatcaaaatcattatatccatacaaatataacccaggaatggttaaatatcttctctttatttgacagtgcttcccatgcaatttagcatattaa

SEQ ID NO: 1076 - DNA, 401 bp, Homo sapiens
ctgactgcgtgagccttcagaaaagcatcggcataaaacaataattatctgtgaatgacaatgacttaaaatggccatacctaaagatctgatgarwgttcattataagtcaattgataaagaaatttggtygtttctctgacatacaggattttaagataataatgtgataccaagacatctcatgaacagcaagggcaytgacagatttctaggaattttatatgatttctgaaaaatcaaaatcattatatccatacaaatataacccaggaatggttaaatatcttctctttatttgacagtgcttcccatgcaatttagcatattaaataagctcatctctctttttacaaactgagagaacaaatcctttgagagttttccaggggccctctggg

SEQ ID NO: 1077 - DNA, 401 bp, Homo sapiens
gaggccaggagttcaagaccagcctaggcaatatagtgagaccctgtctctctaagaacaaaaaatagattaataaaccaagaaaacttgctcattttaaaagtagttttgcatcaatacactactgtattagtccattcttgcattgctgtaaagaaatacctgagattgggtaatttacaaagaaaagaggttgactcrcagctctgyaggctatacaagaagcatagcagcttctgcttcttgggaggcatcgggaagcctccaatcatggcagaaggtgaaggtggagtaggcgtcttacatggcaggagcaggagcaacagagggtaaggggtcaggtgccacacaattttaaatgaccagatcttacgagaactcggtcactatcatgagtacag

SEQ ID NO: 1078 - DNA, 401 bp, Homo sapiens
agttcaagaccagcctaggcaatatagtgagaccctgtctctctaagaacaaaaaatagattaataaaccaagaaaacttgctcattttaaaagtagttttgcatcaatacactactgtattagtccattcttgcattgctgtaaagaaatacctgagattgggtaatttacaaagaaaagaggttgactcrcagctctgyaggctatacaagaagcatagcagcttctgcttcttgggaggcatcgggaagcctccaatcatggcagaaggtgaaggtggagtaggcgtcttacatggcaggagcaggagcaacagagggtaaggggtcaggtgccacacaattttaaatgaccagatcttacgagaactcggtcactatcatgagtacagtaccaagag

SEQ ID NO: 1079 - DNA, 401 bp, Homo sapiens
cagcgtggccacacaatgtaagattctctctctcttctgttctctctctctctctttcactgacctttacaactttctatatcaactcacatttttgtcctttattttcgtctttcttatttaaatgacctctaaactactctaggataaaagtcactgtcatttttctttaacaaaaacacatctcactctccttgtackctttgcctgcagagttttgtttcttcatcctattattactagtagttcatttacayatatttattagatttcttaacccttagtaacattaactttcagtgaaaatgaagaaataaacaatcataaactgtcagttacatacatgcattctgtgctacattagcacaggtataaatacattctctcataatttctagagg

SEQ ID NO: 1080 - DNA, 401 bp, Homo sapiens
tcactgacctttacaactttctatatcaactcacatttttgtcctttattttcgtctttcttatttaaatgacctctaaactactctaggataaaagtcactgtcatttttctttaacaaaaacacatctcactctccttgtackctttgcctgcagagttttgtttcttcatcctattattactagtagttcatttacayatatttattagatttcttaacccttagtaacattaactttcagtgaaaatgaagaaataaacaatcataaactgtcagttacatacatgcattctgtgctacattagcacaggtataaatacattctctcataatttctagaggcatgtttcctaacagtacaacttctcagtgtggcaaaagagcaggtttattaacag

SEQ ID NO: 1081 - DNA, 401 bp, Homo sapiens
gtgctacattagcacaggtataaatacattctctcataatttctagaggcatgtttcctaacagtacaacttctcagtgtggcaaaagagcaggtttattaacagatccaaatacctttagtctctgccaaattaagaagtcaaaagtagccgggcgcagtggctcacgcctgtaatcccagcacttcgggaggctgagaygggcggatcatgaggtcaggagatggagaccatcctggctaacacaatgaaaccccatctctactaaaaatacaaaaaaaattagctgggcatggtggcgggcgcctgtagtcccagctactcaggaggctgaggcagaagaatggcgtgaaccagggaggcggagcttgcagtaagccgagatggtgccactgcactcc

SEQ ID NO: 1082 - DNA, 401 bp, Homo sapiens
aaaaatacaaaaaaaattagctgggcatggtggcgggcgcctgtagtcccagctactcaggaggctgaggcagaagaatggcgtgaaccagggaggcggagcttgcagtaagccgagatggtgccactgcactccagcctgggctacagagcgagactctgtctcagaaaaaaaaaaaaaaaaaaaaaaaaaaaaggaaayaaacttaaatagataaactttagtaattagtattttggtattttattttctttgaaattatctacctatttcatgaatatccgtcatttaacttagtataactttaagatttcaagtaaccaaaaagatgtcggaaactatttttaagtcactgtactataaaacagttattgttgaaataaagtttgtcagagtaatga

SEQ ID NO: 1083 - DNA, 401 bp, Homo sapiens
catgcttgagcccacttacccaactcctgcgatcttagccggaagctgctgatcagcagtttcaggctcttcctatctgttgggagcctgcctttccctggtgccagctgcaaccaattattattttagagagacagttaaggactgcctgtccatcacctgatggtcgtctgacattcctggttgtggggaaagggaacmctctcctgccctgctcatgtctgactagctacctgctgtaacaaaactagttttatttaccaaagattatcttatatcagataaacttgaaaacatgttggttatatttaaccattaaataatatatttggttatatttctgagtgttttagcaatacttataagygtttttttaagccaacttagaatagaactcattt

SEQ ID NO: 1084 - DNA, 401 bp, Homo sapiens
tcgtctgacattcctggttgtggggaaagggaacmctctcctgccctgctcatgtctgactagctacctgctgtaacaaaactagttttatttaccaaagattatcttatatcagataaacttgaaaacatgttggttatatttaaccattaaataatatatttggttatatttctgagtgttttagcaatacttataagygtttttttaagccaacttagaatagaactcatttattaatttggtaataccatcatgaagtgaggaaatgtcacataggtacaacgtacatacatatatacacacataaacatataaagatttatttattttaaaatttaatttatttaaagacagaaacagatagagattattttaagattttagccacaggtcaggta

SEQ ID NO: 1085 - DNA, 401 bp, Homo sapiens
ccttgagaagacagttttgggtggtagaatattttacagctgaaggaggaagagaaaggatgtaaactttcaagtagtccctttaaaagggagttttcgggcatttttgtctgttacagggttgctgcgtatcattgttgttattatcaattgttattttctgggacaaacagtaaattcttctggtagcactaagctttrtcaagcaggcattttaaaagtggggttggggggatgatttttgatgggtgtgaattttaagttcttgtctaaatctaatttatgcttgttaattttgttaagggagctatccagtctaaccatgatacacttgtttccttctttcaacttgatcctcccataggtagcaatacgatgtttatttagggtgagagctctct

SEQ ID NO: 1086 - DNA, 401 bp, Homo sapiens
agactctgccctcatgatggaaagtcattcccaaaaatagccaaagagaaagcgagctgagaccctcatggtcacaggcagcaaaaatggtgtttgtgaaaatggtatctccagcgttacacaaaagtgaggcacctgcaatcacagacttgtggacctgtgacacttgggaggcaatacggagatgggactttttcagcmctaataagacaatgaggaaggacaacaagtgccttgtatgagctgagacactttatttagacaaattccccagattgctgacatagccaggtgggaaattttgctagtgttttttagggtccttgactgacagcgagcacctccagactcaggcccaaccacctgtgcttcccagtgggcaaaaacacagacagaggtga

SEQ ID NO: 1087 - DNA, 401 bp, Homo sapiens
cgtagctaaaccagctaacacttttcaaccattaacaaagaatggtagagtggaatgtggtggcacatgcctatagtcctaactactcaggaagctgaggtaggaggactccttaagcccaggagtttgaggtcaacctgggcaatatacaatatagtgaggccctgtagagatctataatatgttctgctgtaaacatawgtccacaatataagggccatttttttttttttgagacagagtttcacactgtcgcccgggctggagtgtagtggtgcgatcgctgctcactgcaacctccacctcccaggttcaagcaattctcctgcctcagcctcccgagtagctgggattacaggtacctgccaccatacccagctagtttttttttttttgtattt

SEQ ID NO: 1088 - DNA, 401 bp, Homo sapiens
gttttttgtttgtttgtttgtgtgagacagagtctcactccgtcactcaggctggagtgcagtggggcaatcttgggtcactgcaacctctacctcccaggttcaagcaattctcaggcctcagcttcctgagtagctggactataggcacacaccaccatgcccaaataatttttatattcttagtagagatggagtctyaccatgttggcaacgctagtctcgaactcctgacctcaaacgatttacccacttcagcctcccaaagtgctgggatcacaggtatgagccaccgtgcctggcctatacttgtgtatactttgaattgtttcttttttcttttcctattttattttattttattttatattttattttattttattttttgygacagggtc

SEQ ID NO: 1089 - DNA, 401 bp, Homo sapiens
atggagtctyaccatgttggcaacgctagtctcgaactcctgacctcaaacgatttacccacttcagcctcccaaagtgctgggatcacaggtatgagccaccgtgcctggcctatacttgtgtatactttgaattgtttcttttttcttttcctattttattttattttattttatattttattttattttattttttgygacagggtctggctctgtcacccaggctggagtacagtggtgcaatcatgactcactgcagcctcaagctcctgtgctcaggtgatcagcctcctaggtagctgggactacaggtgaccaccatcacacccagctaatttttgtattttttcatagagatgaggtttcaccatgttgcccaggctggtctcaaattccca

SEQ ID NO: 1090 - DNA, 401 bp, Homo sapiens
accctgaaaaaaatctctggggagaggatcccaaagagacaaaggctaattttctcaccatgcttatagattaggggctttgagaaaatgagggtatgtttttaaagtattttaatagtggactgatctattttacctcctggaccagatgaaatgggaactgttccaattcatggagcaaccagacatacatgttcaaayaattatgaaaaacatacaacagatatttatcaacaaatacatcagtaaacaaacttacatgaccctgcttggccatcactgtttcttttcaacacacacacacacatttacaaatacatatatatgtgtgtgtgtgtgtctgtctgtcgatatatatgtgtatatatatatatatatatatatatatatataaataaaat

SEQ ID NO: 1091 - DNA, 401 bp, Homo sapiens
tttatttgttttagttttaagaatatccaaacaaagacggatacatgtgaaaacttgggacagtaaaattgtgacctttctataaagacaaagaggtaggaatcaagccaaagtgagattaggataatgtcaggtcttagtactctattctgcataatagtttattttaggtaattctctatattggttggcttgctgaarctggtgtgtgtgtgtgtgtgtgtgtatgcgtgtgtgcgtgtgtgtgtgtgtgtgtgtataaaaaatctttttagtcgttcttttttatttgtgcttctcaacatgcttaagcaagtgatatctttccatataaggggcaaaagaatttggggctgtgaggcaggctgacaaagaggaaatatatcctgtctaagcaagca

SEQ ID NO: 1092 - DNA, 401 bp, Homo sapiens
aagattgttccaggatttaaaaatttaagattactttggtttcttggaattatttaatacacactgcaattttccctgaaaaacacatgtaagctaaaatggctctatggaaatgttttatgttttaatgaggttgggaaacagagataaattcacctggtcataatcatatggtaaatattgatgaaaggaacctttttytaaactgcatagctataattctattccagctgattttgtagatttaaaatattttaccctgtttttgtgtctcttaaggagtttctgtttgggttatttgtacagatcaacagataaaaacttatgtcctagaacaaaaacagcacacttaaacacatcttttctttcaggccaaaaagtttgctgtttcaggaccatgg

SEQ ID NO: 1093 - DNA, 401 bp, Homo sapiens
atcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttgkatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagaga

SEQ ID NO: 1094 - DNA, 401 bp, Homo sapiens
atggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctggttgacatcsaktcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttt

SEQ ID NO: 1095 - DNA, 401 bp, Homo sapiens
ggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctggttgacatcsaktcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtattttta

SEQ ID NO: 1096 - DNA, 401 bp, Homo sapiens
atgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaacyttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataat

SEQ ID NO: 1097 - DNA, 401 bp, Homo sapiens
ggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactmttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttc

SEQ ID NO: 1098 - DNA, 401 bp, Homo sapiens
ctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattatttkgtgtctttctcttccccatcatagatttcctgtcatctctctgttaccctctacctctcagcgaccccaagctgcctgtwgtctctctctccttcccgttccctaaccacttctccctacttttgtatcttaattggttctttgagattacagcaagtcttaagacatttacggtgctagcctctcactagcttgagacg

SEQ ID NO: 1099 - DNA, 401 bp, Homo sapiens
aagtcatgcttgaatttaagttaaattcaatttatttctaacacattttaaaattaaaacatcacgccatctcttatgttttatagaaatgtgactttcatataccagtgagtattatttkgtgtctttctcttccccatcatagatttcctgtcatctctctgttaccctctacctctcagcgaccccaagctgcctgtwgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtagg

SEQ ID NO: 1100 - DNA, 401 bp, Homo sapiens
cacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcaragagcccacgctcttaaaaacaatacattcctgtttgcattgmgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaat

SEQ ID NO: 1101 - DNA, 401 bp, Homo sapiens
tcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcaragagcccacgctcttaaaaacaatacattcctgtttgcattgmgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttctt

SEQ ID NO: 1102 - DNA, 401 bp, Homo sapiens
tgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtaraaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgc

SEQ ID NO: 1103 - DNA, 401 bp, Homo sapiens
cagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaaraaaaaaatgccctttgaaaaacacttcaactaaattctataattttgtcatctgaggaaatcaggaaaacaaagaaacwtctaacacattttcctgatctaagaccatgtcagaaagtatgttgtgaagttttgataaattattttataaagtaaatttttctactaagtgttttagtagattacatattccttatcagt

SEQ ID NO: 1104 - DNA, 401 bp, Homo sapiens
aaaaagcaagtacagatcctgcaaaaagaagcgaaattcaccaggaggacaaggttacttgatcattttaaacttgtctttaattgaaatctgcttgaacaggtttcattgtccagagaaaraaaaaaatgccctttgaaaaacacttcaactaaattctataattttgtcatctgaggaaatcaggaaaacaaagaaacwtctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatc

SEQ ID NO: 1105 - DNA, 401 bp, Homo sapiens
actttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaaraaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcascatattcagcacattatgcacagagct

SEQ ID NO: 1106 - DNA, 401 bp, Homo sapiens
tacaaagggattgtatttttcaactaaraaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcascatattcagcacattatgcacagagctgtagccttcaaggtcwtagactgttgaaggctaattgattcttctttatcctggagcctgagagagtagaagagagacaatcccagtaattgtgtctgcagcgttgctccccaaaccaatctaccwactaatgttagagttttattttataaatactagaattactccctcac

SEQ ID NO: 1107 - DNA, 401 bp, Homo sapiens
cacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcascatattcagcacattatgcacagagctgtagccttcaaggtcwtagactgttgaaggctaattgattcttctttatcctggagcctgagagagtagaagagagacaatcccagtaattgtgtctgcagcgttgctccccaaaccaatctaccwactaatgttagagttttattttataaatactagaattactccctcactgactcttgtcaaattacaacattctttgtctttgttataata

SEQ ID NO: 1108 - DNA, 401 bp, Homo sapiens
tggttttaggactttattctcccgtttccatttttttttctgtctcascatattcagcacattatgcacagagctgtagccttcaaggtcwtagactgttgaaggctaattgattcttctttatcctggagcctgagagagtagaagagagacaatcccagtaattgtgtctgcagcgttgctccccaaaccaatctaccwactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaa

SEQ ID NO: 1109 - DNA, 401 bp, Homo sapiens
tgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggcyaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactat

SEQ ID NO: 1110 - DNA, 401 bp, Homo sapiens
tagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtatwgactcttttttatttttgtaattatgtcattttggctttataggtcagtatttcattgcatcatatcaaaataatttcaactrtctttaatgaaactttattgcattttaatgctgaatggcactttcatatattacaaacatacaaaaaaaatctctagccaatgaccaatataccagtttcttaatgacataattaaa

SEQ ID NO: 1111 - DNA, 401 bp, Homo sapiens
tgctctgtggctcacttcttttcttcataacccattttgttttctcctctctattcttttgtgatacccaactcagacttcttctcccctttccttcctaccttcccaattatgtatwgactcttttttatttttgtaattatgtcattttggctttataggtcagtatttcattgcatcatatcaaaataatttcaactrtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatca

SEQ ID NO: 1112 - DNA, 401 bp, Homo sapiens
cctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaaygtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatg

SEQ ID NO: 1113 - DNA, 401 bp, Homo sapiens
acctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcarattattaactatatttacttctgaagtctcttacaactctggttctctcagtttattgtctcagggtgttagctttccagtgggtaracttgactttcaatcctacttgtccctcttcatggccttgagcaagttagaccatcatgttaaatctgtttcctcatttaaatgtgataataataataatatacatgtcttga

SEQ ID NO: 1114 - DNA, 401 bp, Homo sapiens
atgatcaacgttatcccaactgaaatgcgttacatacttagaaagaaattagttccttagtgcttaaagtattcaagcagtgacactgttgagggagatttatgttcctagcarattattaactatatttacttctgaagtctcttacaactctggttctctcagtttattgtctcagggtgttagctttccagtgggtaracttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtc

SEQ ID NO: 1115 - DNA, 401 bp, Homo sapiens
ttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctytgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagat

SEQ ID NO: 1116 - DNA, 401 bp, Homo sapiens
gggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccarccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccatt

SEQ ID NO: 1117 - DNA, 401 bp, Homo sapiens
ctagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtatkttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtg

SEQ ID NO: 1118 - DNA, 401 bp, Homo sapiens
tttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgsttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttg

SEQ ID NO: 1119 - DNA, 401 bp, Homo sapiens
ctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacamttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtca

SEQ ID NO: 1120 - DNA, 401 bp, Homo sapiens
ggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcrttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacc

SEQ ID NO: 1121 - DNA, 401 bp, Homo sapiens
attccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaaygctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagaca

SEQ ID NO: 1122 - DNA, 401 bp, Homo sapiens
ggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaacmagaaatcatatactatcttagcaggcrtatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagtta

SEQ ID NO: 1123 - DNA, 401 bp, Homo sapiens
ttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaacmagaaatcatatactatcttagcaggcrtatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagca

SEQ ID NO: 1124 - DNA, 401 bp, Homo sapiens
tctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcytgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgt

SEQ ID NO: 1125 - DNA, 401 bp, Homo sapiens
aaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacrgctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgtt

SEQ ID NO: 1126 - DNA, 401 bp, Homo sapiens
cagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgwacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattt

SEQ ID NO: 1127 - DNA, 401 bp, Homo sapiens
ctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctcttwacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgatt

SEQ ID NO: 1128 - DNA, 401 bp, Homo sapiens
atcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctytacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaagga

SEQ ID NO: 1129 - DNA, 401 bp, Homo sapiens
gtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatkaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgt

SEQ ID NO: 1130 - DNA, 401 bp, Homo sapiens
taactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagakgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccatt

SEQ ID NO: 1131 - DNA, 401 bp, Homo sapiens
catttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaargtacagtaaaaatacagtattataatcttatgggaccactgtcrtagatgcagtttcctgttgaccaaaatgtccttatatggcacgtgatggtatatgccatattttgtttawctcttcttgcatcagtgaacacttgggttacttccacctcttaaccggttaataatactgatatgaacatgggtataacattctaa

SEQ ID NO: 1132 - DNA, 401 bp, Homo sapiens
cttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaargtacagtaaaaatacagtattataatcttatgggaccactgtcrtagatgcagtttcctgttgaccaaaatgtccttatatggcacgtgatggtatatgccatattttgtttawctcttcttgcatcagtgaacacttgggttacttccacctcttaaccggttaataatactgatatgaacatgggtataacattctaattawgttttgttcatctgtggtgggtgtgaaagttaaaccaatg

SEQ ID NO: 1133 - DNA, 401 bp, Homo sapiens
caagtatgttactgtactaagtagtataggcaattgtaacacaatcgtaagtatttatatatgtaaacatatctaaacagagaaaargtacagtaaaaatacagtattataatcttatgggaccactgtcrtagatgcagtttcctgttgaccaaaatgtccttatatggcacgtgatggtatatgccatattttgtttawctcttcttgcatcagtgaacacttgggttacttccacctcttaaccggttaataatactgatatgaacatgggtataacattctaattawgttttgttcatctgtggtgggtgtgaaagttaaaccaatggaacctttttttagtgaatttagtcaaatttctgaaaamcaagaattcctatggaaacatactgataaac

SEQ ID NO: 1134 - DNA, 401 bp, Homo sapiens
cagtaaaaatacagtattataatcttatgggaccactgtcrtagatgcagtttcctgttgaccaaaatgtccttatatggcacgtgatggtatatgccatattttgtttawctcttcttgcatcagtgaacacttgggttacttccacctcttaaccggttaataatactgatatgaacatgggtataacattctaattawgttttgttcatctgtggtgggtgtgaaagttaaaccaatggaacctttttttagtgaatttagtcaaatttctgaaaamcaagaattcctatggaaacatactgataaacatacttttcttattatatattaaaaatgcttgtagggaaaacccagcttctaatagtactctgggtttgtgaagatgcagtaagtgcttg

SEQ ID NO: 1135 - DNA, 401 bp, Homo sapiens
gcacgtgatggtatatgccatattttgtttawctcttcttgcatcagtgaacacttgggttacttccacctcttaaccggttaataatactgatatgaacatgggtataacattctaattawgttttgttcatctgtggtgggtgtgaaagttaaaccaatggaacctttttttagtgaatttagtcaaatttctgaaaamcaagaattcctatggaaacatactgataaacatacttttcttattatatattaaaaatgcttgtagggaaaacccagcttctaatagtactctgggtttgtgaagatgcagtaagtgcttgctaragagatgtttttaatctagagagctagagcagagacttagagttcacttgtttcttctctttttttcaatcattt

SEQ ID NO: 1136 - DNA, 401 bp, Homo sapiens
ttgttcatctgtggtgggtgtgaaagttaaaccaatggaacctttttttagtgaatttagtcaaatttctgaaaamcaagaattcctatggaaacatactgataaacatacttttcttattatatattaaaaatgcttgtagggaaaacccagcttctaatagtactctgggtttgtgaagatgcagtaagtgcttgctaragagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggat

SEQ ID NO: 1137 - DNA, 401 bp, Homo sapiens
agagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatarataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccscatctctgctaaagayacaaaaattag

SEQ ID NO: 1138 - DNA, 401 bp, Homo sapiens
aaaaggatctcattacatttttccatarataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccscatctctgctaaagayacaaaaattagccaggtgtaatggtgggtgcctgtagtcccagctacttgagaggctgaggcaggagaatcacttgaacctgggaggtrgaggttgtagtgagccgagatctcatgactgcactccagccagggcgacagagtgagactccatctcaaaaaaaaaaaaaagtgacatgctggtt

SEQ ID NO: 1139 - DNA, 401 bp, Homo sapiens
atttttccatarataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccscatctctgctaaagayacaaaaattagccaggtgtaatggtgggtgcctgtagtcccagctacttgagaggctgaggcaggagaatcacttgaacctgggaggtrgaggttgtagtgagccgagatctcatgactgcactccagccagggcgacagagtgagactccatctcaaaaaaaaaaaaaagtgacatgctggttaaaggtccctgtccat

SEQ ID NO: 1140 - DNA, 401 bp, Homo sapiens
actcacacctgtaatctcagcactttgggaggccgaggcaagcggatcacctgagggcaggagttggagaccagcctggccaaaatggtggaaccscatctctgctaaagayacaaaaattagccaggtgtaatggtgggtgcctgtagtcccagctacttgagaggctgaggcaggagaatcacttgaacctgggaggtrgaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagact

SEQ ID NO: 1141 - DNA, 401 bp, Homo sapiens
tgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagawtcctattgttttcagcaaataggagtttccttctctgtaagcattgctgactcaagactatataatgttagaaatagaaaaaagatragaacatgttagtatcaatagcctttattattataatcggtatgggcctaacttctgctagcaacattaaaaatcttttcttttactctatcatttagtaacggattttcttt

SEQ ID NO: 1142 - DNA, 401 bp, Homo sapiens
cctggtcatattttagcataattaattataccaactattaatttaatattttgtttgatttttagtttccagggtaaaacattaattttctctttaatttccattctataagawtcctattgttttcagcaaataggagtttccttctctgtaagcattgctgactcaagactatataatgttagaaatagaaaaaagatragaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatcca

SEQ ID NO: 1143 - DNA, 401 bp, Homo sapiens
atagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccasttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggt

SEQ ID NO: 1144 - DNA, 401 bp, Homo sapiens
gatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttmatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctgg

SEQ ID NO: 1145 - DNA, 401 bp, Homo sapiens
tggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatgrtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcakggaattatgtgtgt

SEQ ID NO: 1146 - DNA, 401 bp, Homo sapiens
agttttgcctgatgrtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcakggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaa

SEQ ID NO: 1147 - DNA, 401 bp, Homo sapiens
tcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagaygtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggargcccagagagg

SEQ ID NO: 1148 - DNA, 401 bp, Homo sapiens
atattagaagaygtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggargcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgag

SEQ ID NO: 1149 - DNA, 401 bp, Homo sapiens
tccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccargaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctca

SEQ ID NO: 1150 - DNA, 401 bp, Homo sapiens
ctaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcrcatcagagagccttcataacaaatgagaggartggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgc

SEQ ID NO: 1151 - DNA, 401 bp, Homo sapiens
ggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcrcatcagagagccttcataacaaatgagaggartggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttscaccttttt

SEQ ID NO: 1152 - DNA, 401 bp, Homo sapiens
atgagaggartggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttscacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaata

SEQ ID NO: 1153 - DNA, 401 bp, Homo sapiens
aaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtktttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatgggg

SEQ ID NO: 1154 - DNA, 401 bp, Homo sapiens
ggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaamtagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagc

SEQ ID NO: 1155 - DNA, 401 bp, Homo sapiens
catatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcrtataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtc

SEQ ID NO: 1156 - DNA, 401 bp, Homo sapiens
tttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcrgtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgaygaaaatt

SEQ ID NO: 1157 - DNA, 401 bp, Homo sapiens
attgtgcrgtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgaygaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttt

SEQ ID NO: 1158 - DNA, 401 bp, Homo sapiens
tcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattsgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttaca

SEQ ID NO: 1159 - DNA, 401 bp, Homo sapiens
ctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacraagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgtt

SEQ ID NO: 1160 - DNA, 401 bp, Homo sapiens
tttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaaytgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatactttt

SEQ ID NO: 1161 - DNA, 401 bp, Homo sapiens
ctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggaggtcagtatcacaacacarccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccagggggg

SEQ ID NO: 1162 - DNA, 401 bp, Homo sapiens
tttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcrtgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttcc

SEQ ID NO: 1163 - DNA, 401 bp, Homo sapiens
ttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgrcactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatrttactgacaaatgctatttttatctcctatatgggtgaatca

SEQ ID NO: 1164 - DNA, 401 bp, Homo sapiens
agcacatttctaacaaggaccaaaacttttttctcaccaatgrcactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatrttactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtc

SEQ ID NO: 1165 - DNA, 401 bp, Homo sapiens
aaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacrtggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctg

SEQ ID NO: 1166 - DNA, 401 bp, Homo sapiens
tatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttattwgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatg

SEQ ID NO: 1167 - DNA, 401 bp, Homo sapiens
ccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggmaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctccca

SEQ ID NO: 1168 - DNA, 401 bp, Homo sapiens
tctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgatamcagcatcttttacacagtgatgaattaataattaaaccaaacaaaaccaaacaacaaaacagttttacagctacttgggaaatatctgtaaacaaagtttcmtaataattaactcttggaatatcgtcacttgtacaaatgctgcaattctagcaagtttgggacacttacaggaaactgtctgcaaataaacatgtata

SEQ ID NO: 1169 - DNA, 401 bp, Homo sapiens
tttaaaatgtattaactgagaactaaagatagcaaagtgttgtcaatattataaagtatagtaagacagcatagaactacatggagaatatattgatamcagcatcttttacacagtgatgaattaataattaaaccaaacaaaaccaaacaacaaaacagttttacagctacttgggaaatatctgtaaacaaagtttcmtaataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgcca

SEQ ID NO: 1170 - DNA, 401 bp, Homo sapiens
ccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaarttgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgca

SEQ ID NO: 1171 - DNA, 401 bp, Homo sapiens
ataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatyttggaggagacgttttgcagacaaagcccaactmttttccytccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtct

SEQ ID NO: 1172 - DNA, 401 bp, Homo sapiens
cctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatyttggaggagacgttttgcagacaaagcccaactmttttccytccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataa

SEQ ID NO: 1173 - DNA, 401 bp, Homo sapiens
tcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatyttggaggagacgttttgcagacaaagcccaactmttttccytccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataag

SEQ ID NO: 1174 - DNA, 401 bp, Homo sapiens
atttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccasgctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattg

SEQ ID NO: 1175 - DNA, 401 bp, Homo sapiens
cctactagctgattcacatcgttttcataaccaaaatatagctcatggcttgagtatgaaaccctgaccaaagtatggaatttcacatacatgtcatgataatgtcctagtcagattcagtcctacctcttgcttctgaaaatgtgctagcttctgttctaatcctaattgcatgaattagttcattgtccagtttagaaragaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatasagccagctactccatgctgatttagatctcaatg

SEQ ID NO: 1176 - DNA, 401 bp, Homo sapiens
aattgcatgaattagttcattgtccagtttagaaragaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatasagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccc

SEQ ID NO: 1177 - DNA, 401 bp, Homo sapiens
taggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctytaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctctt

SEQ ID NO: 1178 - DNA, 401 bp, Homo sapiens
ttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaaragactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggc

SEQ ID NO: 1179 - DNA, 401 bp, Homo sapiens
tgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacaccyggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatccccc

SEQ ID NO: 1180 - DNA, 401 bp, Homo sapiens
cttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaaygtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgaggg

SEQ ID NO: 1181 - DNA, 401 bp, Homo sapiens
attttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttgggsatggtggcgcatatctgtaatcccagctactgaggaggctgaggcagaagaatcgcttgkacctgggagttcaaggctgcagtgagctatgatggtgccactgcactccagcatgggtgacagagtgagaccctctctcagaaaaaagaaggaaagaaagagagagagggtgagagagagagagaggaaggaaggaagga

SEQ ID NO: 1182 - DNA, 401 bp, Homo sapiens
aaattactaaacaggctgggcatggtggctcatgcctgtaatctcagcactttgggaggtcgaggaatgagattgcttgagcccaggagtttgagatcatcctaggcaacaagaacaacaacaaaaaacaattagttgggsatggtggcgcatatctgtaatcccagctactgaggaggctgaggcagaagaatcgcttgkacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtac

SEQ ID NO: 1183 - DNA, 401 bp, Homo sapiens
gtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgtkggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaac

SEQ ID NO: 1184 - DNA, 401 bp, Homo sapiens
ctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaawacaatataatcyatcttttttttttttttttttttttgacacagagtcgtgctcttgttgcccaggctggagtgcaatggcgcaatcttgactcaytacaacctccgcctcccaggctcaagcaattctcctgcctcagcctccaagtagctgggattacaggcgtgcgccaccgcacccagctaagttttgtgttttta

SEQ ID NO: 1185 - DNA, 401 bp, Homo sapiens
taacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaawacaatataatcyatcttttttttttttttttttttttgacacagagtcgtgctcttgttgcccaggctggagtgcaatggcgcaatcttgactcaytacaacctccgcctcccaggctcaagcaattctcctgcctcagcctccaagtagctgggattacaggcgtgcgccaccgcacccagctaagttttgtgtttttagtagagacgggg

SEQ ID NO: 1186 - DNA, 401 bp, Homo sapiens
tcaaaaatttttaccacttttgcctgcccttcttacttttttcacaagttaattgaagatggaaggcagtaaagcctcgtgattctttttcaaaaaggttaaaawacaatataatcyatcttttttttttttttttttttttgacacagagtcgtgctcttgttgcccaggctggagtgcaatggcgcaatcttgactcaytacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactyttgacatcaggtgatccacccacctcgacttcccaaagtgctgggattac

SEQ ID NO: 1187 - DNA, 401 bp, Homo sapiens
gtcgtgctcttgttgcccaggctggagtgcaatggcgcaatcttgactcaytacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactyttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtag

SEQ ID NO: 1188 - DNA, 401 bp, Homo sapiens
cgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatactwgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagag

SEQ ID NO: 1189 - DNA, 401 bp, Homo sapiens
tatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttastacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctc

SEQ ID NO: 1190 - DNA, 401 bp, Homo sapiens
ggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccamtgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcatt

SEQ ID NO: 1191 - DNA, 401 bp, Homo sapiens
ttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcytgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgaca

SEQ ID NO: 1192 - DNA, 401 bp, Homo sapiens
tattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataatttyggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattat

SEQ ID NO: 1193 - DNA, 401 bp, Homo sapiens
caagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttktcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggcta

SEQ ID NO: 1194 - DNA, 401 bp, Homo sapiens
tctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttggggcatttgtrttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgwgtagctgggatt

SEQ ID NO: 1195 - DNA, 401 bp, Homo sapiens
tggggcatttgtrttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgwgtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagtt

SEQ ID NO: 1196 - DNA, 401 bp, Homo sapiens
acagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtc

SEQ ID NO: 1197 - DNA, 401 bp, Homo sapiens
gggcattcctcacctctgtagtcttattatctggccttgaaacactacgacattctttaactgaatttattaggggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaa

SEQ ID NO: 1198 - DNA, 401 bp, Homo sapiens
ttcctcacctctgtagtcttattatctggccttgaaacactacgacattctttaactgaatttattaggggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgta

SEQ ID NO: 1199 - DNA, 401 bp, Homo sapiens
ttattatctggccttgaaacactacgacattctttaactgaatttattaggggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtc

SEQ ID NO: 1200 - DNA, 401 bp, Homo sapiens
cgacattctttaactgaatttattaggggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtcagcagctgacaggatagaacacat

SEQ ID NO: 1201 - DNA, 401 bp, Homo sapiens
ttattaggggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgt

SEQ ID NO: 1202 - DNA, 401 bp, Homo sapiens
gggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattctta

SEQ ID NO: 1203 - DNA, 401 bp, Homo sapiens
agaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttt

SEQ ID NO: 1204 - DNA, 401 bp, Homo sapiens
gtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatac

SEQ ID NO: 1205 - DNA, 401 bp, Homo sapiens
cctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaa

SEQ ID NO: 1206 - DNA, 401 bp, Homo sapiens
cagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattwagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaa

SEQ ID NO: 1207 - DNA, 401 bp, Homo sapiens
aagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattygagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtga

SEQ ID NO: 1208 - DNA, 401 bp, Homo sapiens
aaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggamtacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttga

SEQ ID NO: 1209 - DNA, 401 bp, Homo sapiens
actgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcartttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtmattttacaagactgtagaattataa

SEQ ID NO: 1210 - DNA, 401 bp, Homo sapiens
agaaagaatgcatacagttttatcartttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtmattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttc

SEQ ID NO: 1211 - DNA, 401 bp, Homo sapiens
cctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattamtcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttg

SEQ ID NO: 1212 - DNA, 401 bp, Homo sapiens
gaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaarttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcat

SEQ ID NO: 1213 - DNA, 401 bp, Homo sapiens
agctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggamtatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtct

SEQ ID NO: 1214 - DNA, 401 bp, Homo sapiens
atgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcrtttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaa

SEQ ID NO: 1215 - DNA, 401 bp, Homo sapiens
tacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcarttctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgta

SEQ ID NO: 1216 - DNA, 401 bp, Homo sapiens
ttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctytttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagct

SEQ ID NO: 1217 - DNA, 401 bp, Homo sapiens
ttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtaratattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatct

SEQ ID NO: 1218 - DNA, 401 bp, Homo sapiens
tataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattytcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaa

SEQ ID NO: 1219 - DNA, 401 bp, Homo sapiens
gtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgamcaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatattttggattcaagatggactactgctatcaattgattagattgaaaacaagcaagcaag

SEQ ID NO: 1220 - DNA, 401 bp, Homo sapiens
caagtaggtgtttaaaggcttaaattgagcaaagaataaaatggtattttttaaatgttaaagaatgatgatgtgttttaatagtattgttaactattgaatcaatttatgtttagtctgcttaaaattatattttggattcaagatggactactgctatcaattgattagattgaaaacaagcaagcaagaatctagacracacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgac

SEQ ID NO: 1221 - DNA, 401 bp, Homo sapiens
gctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaamtcctgtgctyttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagactt

SEQ ID NO: 1222 - DNA, 401 bp, Homo sapiens
ttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaamtcctgtgctyttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaat

SEQ ID NO: 1223 - DNA, 401 bp, Homo sapiens
atttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtmtcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagag

SEQ ID NO: 1224 - DNA, 401 bp, Homo sapiens
cagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtyttgaaytccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcat

SEQ ID NO: 1225 - DNA, 401 bp, Homo sapiens
cttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtyttgaaytccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtga

SEQ ID NO: 1226 - DNA, 401 bp, Homo sapiens
gttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacrtattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatc

SEQ ID NO: 1227 - DNA, 401 bp, Homo sapiens
tcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcrggggaagacctcagtcattctgagttattacagctccaggagatggaagtgttttattagcccatatatatatagatagatacagtgctaccaggaaaaaactaatgaattataactaaggtcctwtgtatggaccttaatattccttgtgtctgacgatgcaggaatttagccaggcaagctgagataaggccctaacc

SEQ ID NO: 1228 - DNA, 401 bp, Homo sapiens
atggaaagaacaaagatctgtattaaacacatgcttgcagcgtctacaaaaatggtttatgttttaaaagaagcrggggaagacctcagtcattctgagttattacagctccaggagatggaagtgttttattagcccatatatatatagatagatacagtgctaccaggaaaaaactaatgaattataactaaggtcctwtgtatggaccttaatattccttgtgtctgacgatgcaggaatttagccaggcaagctgagataaggccctaacctttgctctacttttctttttatgatcttyttccacatgcccttttttggtttaaatataaccaagatgatttccattagatttttctaacaactgcatgatgtgtgtgcgtgcgtgtgtgcatgtg

SEQ ID NO: 1229 - DNA, 401 bp, Homo sapiens
tacagctccaggagatggaagtgttttattagcccatatatatatagatagatacagtgctaccaggaaaaaactaatgaattataactaaggtcctwtgtatggaccttaatattccttgtgtctgacgatgcaggaatttagccaggcaagctgagataaggccctaacctttgctctacttttctttttatgatcttyttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatg

SEQ ID NO: 1230 - DNA, 401 bp, Homo sapiens
tttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcrgcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtca

SEQ ID NO: 1231 - DNA, 401 bp, Homo sapiens
ttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaarggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatg

SEQ ID NO: 1232 - DNA, 401 bp, Homo sapiens
ccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaaytgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcatt

SEQ ID NO: 1233 - DNA, 401 bp, Homo sapiens
aataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtraggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcaga

SEQ ID NO: 1234 - DNA, 401 bp, Homo sapiens
attttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttaytaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcacc

SEQ ID NO: 1235 - DNA, 401 bp, Homo sapiens
ttctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctrgttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagca

SEQ ID NO: 1236 - DNA, 401 bp, Homo sapiens
ctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcmaatggcgtagagttatttggtttaattttctgtaagtaactcgtaaagaattgtcctaaaagctgtgggtgaggactaattcattcaagggaaacaggatctaatgattgcyttgtgaggtatatatacactgtatactcatgctaattcctgctaattgtcaaagaagaatagtggctttttatcagcagtttgcattt

SEQ ID NO: 1237 - DNA, 401 bp, Homo sapiens
ttacaggtaaggttaaaaaaaatctgtaattttgtagtgactagcagtttaatattcaaacatttaaaatgtgcatattttattaagcmaatggcgtagagttatttggtttaattttctgtaagtaactcgtaaagaattgtcctaaaagctgtgggtgaggactaattcattcaagggaaacaggatctaatgattgcyttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcct

SEQ ID NO: 1238 - DNA, 401 bp, Homo sapiens
actgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggaktccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaat

SEQ ID NO: 1239 - DNA, 401 bp, Homo sapiens
cagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaattttttttttttttttttttttttttttgaracagagtttctctctgtcacccaggcttsagtgcggcagtgcaatctcggctcactgcaaccaccacctcccaggttcaagcgattctcctgcctcaacctcctgagtagttgggattacaggggcacgccaccatgcttagctaatttttgtatttttagtaragacggggtttcaccatgttggtcaggctggtcgca

SEQ ID NO: 1240 - DNA, 401 bp, Homo sapiens
cagcacaccacaggtggcccattcagcactgtcatctgggacagcaaggataccctgctccatttgtcatcctatggaattctgtcagcagttgaaagcctttcagcacaaaacctttaacattcgaggcaaacttcctaattttttttttttttttttttttttttttgaracagagtttctctctgtcacccaggcttsagtgcggcagtgcaatctcggctcactgcaaccaccacctcccaggttcaagcgattctcctgcctcaacctcctgagtagttgggattacaggggcacgccaccatgcttagctaatttttgtatttttagtaragacggggtttcaccatgttggtcaggctggtcgcaaactcctgacctcatgatcctcccatctc

SEQ ID NO: 1241 - DNA, 401 bp, Homo sapiens
tcctaattttttttttttttttttttttttttttgaracagagtttctctctgtcacccaggcttsagtgcggcagtgcaatctcggctcactgcaaccaccacctcccaggttcaagcgattctcctgcctcaacctcctgagtagttgggattacaggggcacgccaccatgcttagctaatttttgtatttttagtaragacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggat

SEQ ID NO: 1242 - DNA, 401 bp, Homo sapiens
cctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctyttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccag

SEQ ID NO: 1243 - DNA, 401 bp, Homo sapiens
atttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgaragctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatg

SEQ ID NO: 1244 - DNA, 401 bp, Homo sapiens
gacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacacygtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaa

SEQ ID NO: 1245 - DNA, 401 bp, Homo sapiens
aaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgarctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttag

SEQ ID NO: 1246 - DNA, 401 bp, Homo sapiens
tgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcawacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagattta

SEQ ID NO: 1247 - DNA, 401 bp, Homo sapiens
aaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgsgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagt

SEQ ID NO: 1248 - DNA, 401 bp, Homo sapiens
cagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgycttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccaraaccttgagggaagaattggagagtata

SEQ ID NO: 1249 - DNA, 401 bp, Homo sapiens
gagctaattgtctagtggatcattcttgycttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccaraaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaat

SEQ ID NO: 1250 - DNA, 401 bp, Homo sapiens
cgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcmttccwttttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttata

SEQ ID NO: 1251 - DNA, 401 bp, Homo sapiens
ggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcmttccwttttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcagg

SEQ ID NO: 1252 - DNA, 401 bp, Homo sapiens
cagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgaratggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcct

SEQ ID NO: 1253 - DNA, 401 bp, Homo sapiens
acaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttrtcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatt

SEQ ID NO: 1254 - DNA, 401 bp, Homo sapiens
taacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtaracactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaag

SEQ ID NO: 1255 - DNA, 401 bp, Homo sapiens
ttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctratcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaa

SEQ ID NO: 1256 - DNA, 401 bp, Homo sapiens
tattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggargacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacacatatgtatatatat

SEQ ID NO: 1257 - DNA, 401 bp, Homo sapiens
acatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgtygtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaacc

SEQ ID NO: 1258 - DNA, 401 bp, Homo sapiens
tttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcraggttagtcagcttcaaatttgacctaacttgacacagaattcctagttgaaaaaaattgtgttcatcsatatgtggtgtgtggggggtgtgtgtgtgttcrtgtgtgtgtccacacgtatgtgtgtgtatacaggcactccataatcaatgtacagattttagggaggaaaaaagaaaaagcacccacactttcaatag

SEQ ID NO: 1259 - DNA, 401 bp, Homo sapiens
atgagccatttactgatttataaaaactgacttaaaatatgaaagagagggacaaatgtatattttataaggcagtcatttgccttgaaataaaacattatatttatagtactttctaggaaaatattgtcraggttagtcagcttcaaatttgacctaacttgacacagaattcctagttgaaaaaaattgtgttcatcsatatgtggtgtgtggggggtgtgtgtgtgttcrtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctc

SEQ ID NO: 1260 - DNA, 401 bp, Homo sapiens
aaaatatgaaagagagggacaaatgtatattttataaggcagtcatttgccttgaaataaaacattatatttatagtactttctaggaaaatattgtcraggttagtcagcttcaaatttgacctaacttgacacagaattcctagttgaaaaaaattgtgttcatcsatatgtggtgtgtggggggtgtgtgtgtgttcrtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaatttta

SEQ ID NO: 1261 - DNA, 401 bp, Homo sapiens
aaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctgrctagttaacgagaatacagtaaatggcccagggtacatctcttgatgtgtytgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttcca

SEQ ID NO: 1262 - DNA, 401 bp, Homo sapiens
tgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctgrctagttaacgagaatacagtaaatggcccagggtacatctcttgatgtgtytgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctg

SEQ ID NO: 1263 - DNA, 401 bp, Homo sapiens
taaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctwtctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgat

SEQ ID NO: 1264 - DNA, 401 bp, Homo sapiens
cctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaaccmttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcata

SEQ ID NO: 1265 - DNA, 401 bp, Homo sapiens
atcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggargcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttcc

SEQ ID NO: 1266 - DNA, 401 bp, Homo sapiens
aacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttmttcccacccaagcatttcctccctctggttttcttttctttctttatttttcctcccttagtatcaggcatgctgtgccagggacttcagatggctccttaacttttaacctwgttttcccttcctcggtctctctgtcattctgtcagtctgtckgtcctcttggtttgtttttcctttccacctccaacccttttgat

SEQ ID NO: 1267 - DNA, 401 bp, Homo sapiens
tcgctttctaattgtggcttccacatgactgctagattaggagttatgctgtatggaatgacccttccaactttgcatccaccttttmttcccacccaagcatttcctccctctggttttcttttctttctttatttttcctcccttagtatcaggcatgctgtgccagggacttcagatggctccttaacttttaacctwgttttcccttcctcggtctctctgtcattctgtcagtctgtckgtcctcttggtttgtttttcctttccacctccaacccttttgatttgtttttgtatactctatgcagcattctagtcctttacccackgacttctcttttccttctcctcctgttaataatcagtgctatattaatttgatttgacaatgttcttga

SEQ ID NO: 1268 - DNA, 401 bp, Homo sapiens
ttatgctgtatggaatgacccttccaactttgcatccaccttttmttcccacccaagcatttcctccctctggttttcttttctttctttatttttcctcccttagtatcaggcatgctgtgccagggacttcagatggctccttaacttttaacctwgttttcccttcctcggtctctctgtcattctgtcagtctgtckgtcctcttggtttgtttttcctttccacctccaacccttttgatttgtttttgtatactctatgcagcattctagtcctttacccackgacttctcttttccttctcctcctgttaataatcagtgctatattaatttgatttgacaatgttcttgacctgtttactggaatttgattatcatgggctcggcttgtagga

SEQ ID NO: 1269 - DNA, 401 bp, Homo sapiens
ttatttttcctcccttagtatcaggcatgctgtgccagggacttcagatggctccttaacttttaacctwgttttcccttcctcggtctctctgtcattctgtcagtctgtckgtcctcttggtttgtttttcctttccacctccaacccttttgatttgtttttgtatactctatgcagcattctagtcctttacccackgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctc

SEQ ID NO: 1270 - DNA, 401 bp, Homo sapiens
tgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagasagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagt

SEQ ID NO: 1271 - DNA, 401 bp, Homo sapiens
gaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataawactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtg

SEQ ID NO: 1272 - DNA, 401 bp, Homo sapiens
tcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcaragacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggata

SEQ ID NO: 1273 - DNA, 401 bp, Homo sapiens
aatgaaatcccaggatcactagatccttccacttttaaagaagctatagtttcccagagttaagttcccaccgtcactgatctctttagctttttgctccttcctttcaggaattcaaaggaagaatgtggtctccaggggcattcccagccctaccatctcccctctgggtgccctccttcactgcagttcaccctgtaractttattcacatcaccaccaaggtgattccctgacaatgtgaacctcagtgagaggtgaacagagaggactccctgctcctcctctttcagacccaggagctgtctttagccccattctgaagaccacccttttcctgtatttccatccgggctttggtcaagtaagcattcctaaatcccttagagatgagggctctt

SEQ ID NO: 1274 - DNA, 401 bp, Homo sapiens
caaggtgattccctgacaatgtgaacctcagtgagaggtgaacagagaggactccctgctcctcctctttcagacccaggagctgtctttagccccattctgaagaccacccttttcctgtatttccatccgggctttggtcaagtaagcattcctaaatcccttagagatgagggctcttctcctttctgggtctagggstacatcattttgccttcaggtttgaattsctgttccttcagcctcatttctcactgattgcactgttttccctggagatggctttgaggacatcctggaggagccgtgctggggtgtcagcctgccaccctcccctgggcagctgccctgcctgccttcttaacctcacgttggactttcctgttttctctccctttcat

SEQ ID NO: 1275 - DNA, 401 bp, Homo sapiens
agtgagaggtgaacagagaggactccctgctcctcctctttcagacccaggagctgtctttagccccattctgaagaccacccttttcctgtatttccatccgggctttggtcaagtaagcattcctaaatcccttagagatgagggctcttctcctttctgggtctagggstacatcattttgccttcaggtttgaattsctgttccttcagcctcatttctcactgattgcactgttttccctggagatggctttgaggacatcctggaggagccgtgctggggtgtcagcctgccaccctcccctgggcagctgccctgcctgccttcttaacctcacgttggactttcctgttttctctccctttcattcatctttgccaagagatgattcttttaa

SEQ ID NO: 1276 - DNA, 401 bp, Homo sapiens
tttgccaagagatgattcttttaacaccctgactctggatcaaattgttttctatctcctgaagcttctcttcatttgagcttctcttcacttttgactttttttgctcatcgctatttgaaaacggagctatttctacttctttgaattctgaatgttcttctaagggatccaaataaccatcaacatgtaagaaaagckgtctckgtctttctctgagttcttctctaatcactgagagaactataggatatacacagtcatctttgaaaaacccatctcttgggtagtctyttgacctcccagtccctttgtaggaacatctctgctgaagcctgtccctagcatagacaggctgttcttgctttagagcctgaaatgtgtgcgtctcttttccttga

SEQ ID NO: 1277 - DNA, 401 bp, Homo sapiens
aagagatgattcttttaacaccctgactctggatcaaattgttttctatctcctgaagcttctcttcatttgagcttctcttcacttttgactttttttgctcatcgctatttgaaaacggagctatttctacttctttgaattctgaatgttcttctaagggatccaaataaccatcaacatgtaagaaaagckgtctckgtctttctctgagttcttctctaatcactgagagaactataggatatacacagtcatctttgaaaaacccatctcttgggtagtctyttgacctcccagtccctttgtaggaacatctctgctgaagcctgtccctagcatagacaggctgttcttgctttagagcctgaaatgtgtgcgtctcttttccttgactcaga

SEQ ID NO: 1278 - DNA, 401 bp, Homo sapiens
ttgactttttttgctcatcgctatttgaaaacggagctatttctacttctttgaattctgaatgttcttctaagggatccaaataaccatcaacatgtaagaaaagckgtctckgtctttctctgagttcttctctaatcactgagagaactataggatatacacagtcatctttgaaaaacccatctcttgggtagtctyttgacctcccagtccctttgtaggaacatctctgctgaagcctgtccctagcatagacaggctgttcttgctttagagcctgaaatgtgtgcgtctcttttccttgactcagaagaaatgaatttaagagatacatattgttttaatcaaaaactttttttcatttaaccagtaatacagatagtttcaagctatcatcc

SEQ ID NO: 1279 - DNA, 401 bp, Homo sapiens
tcagtttgtataacttctattgctctatctttaaatttactaattttctcttttacagtatctaatcagctgataattctgtctagcatgctgataattctatccatggaattttttttattttcataatttttagctgtaaaagttctgttttattctttttcaatcttctatttttctcattagtttcatggttattcytctaaatctatcaacatatttatgaaagcaattgtaaagtctactaaattgatcatgtctgttatttctggatctatttctgccatgaatatttctccaggttatactgaacatttttctttacatacctcaacatttttgtttggatgttgaatattaaattatcaggtctagattttgttgtcttctccttaaagaac

SEQ ID NO: 1280 - DNA, 401 bp, Homo sapiens
ctccaggttatactgaacatttttctttacatacctcaacatttttgtttggatgttgaatattaaattatcaggtctagattttgttgtcttctccttaaagaacattgaacaattttgttttggcagatacttaagtaatttgcaaatcaacttgatcctttcaagtctacttttaaaattttgttaggtcagatctaragtarcctttaccttagagttggttcagctctaatactaagatatgattcttctggagtctctcctgaatatctgagtttctaatgcattgtctctaagaactttaatgtctcccaaccctgtgtaagctctaggaatttgtcagattaaaactcaccagtagttttggcatactatgtatgacagtttcacccacacat

SEQ ID NO: 1281 - DNA, 401 bp, Homo sapiens
ggttatactgaacatttttctttacatacctcaacatttttgtttggatgttgaatattaaattatcaggtctagattttgttgtcttctccttaaagaacattgaacaattttgttttggcagatacttaagtaatttgcaaatcaacttgatcctttcaagtctacttttaaaattttgttaggtcagatctaragtarcctttaccttagagttggttcagctctaatactaagatatgattcttctggagtctctcctgaatatctgagtttctaatgcattgtctctaagaactttaatgtctcccaaccctgtgtaagctctaggaatttgtcagattaaaactcaccagtagttttggcatactatgtatgacagtttcacccacacatgtcca

SEQ ID NO: 1282 - DNA, 401 bp, Homo sapiens
ctgagtttctaatgcattgtctctaagaactttaatgtctcccaaccctgtgtaagctctaggaatttgtcagattaaaactcaccagtagttttggcatactatgtatgacagtttcacccacacatgtccagtgtactacgggcatcaggtcaagtggacttagatgcagagttctgaagttctacttctgtatacgtktctctcctcaggtactctgtcatctgaattccaacctcctttgcctcctctaatttcagcatctgtattttaagtkaagggagaacttcctgctttacttgaatttctttccttgtcccatgatctggacatgcttctaggtagaaatccagaaccaatgcagggctcactgcatttaccttttctcatggatcacagtc

SEQ ID NO: 1283 - DNA, 401 bp, Homo sapiens
aaaactcaccagtagttttggcatactatgtatgacagtttcacccacacatgtccagtgtactacgggcatcaggtcaagtggacttagatgcagagttctgaagttctacttctgtatacgtktctctcctcaggtactctgtcatctgaattccaacctcctttgcctcctctaatttcagcatctgtattttaagtkaagggagaacttcctgctttacttgaatttctttccttgtcccatgatctggacatgcttctaggtagaaatccagaaccaatgcagggctcactgcatttaccttttctcatggatcacagtcctgaacttcattttatcaaagatctaaaaacagctatttcatattgttttttaatattttatttatgatgcaaagg

SEQ ID NO: 1284 - DNA, 61 bp, Homo sapiens
gctctgggtcccagttgttggtttcagggtrgtgggttctcagcgatcctcagagagggag

SEQ ID NO: 1285 - DNA, 61 bp, Homo sapiens
ggctttgccactggagaaagcccaagtttartcctgggttggggcctcctgaaacttttta

SEQ ID NO: 1286 - DNA, 61 bp, Homo sapiens
tttaatcctttggggtttggctcaccaagtrgatcggaaatgtgccggctgctttcttgtg

SEQ ID NO: 1287 - DNA, 61 bp, Homo sapiens
tgagaattataaagttgttattggtgggggkttttttttttggccaagtcatctcaagaaa

SEQ ID NO: 1288 - DNA, 59 bp, Homo sapiens
attttttttttcctgcagttactcaaccttkcagtgggacaagttgctcaatgacttac

SEQ ID NO: 1289 - DNA, 61 bp, Homo sapiens
ctttacctgtcttgatgcacggtggagaaakgagacccgcttcgttttccctctaatctag

SEQ ID NO: 1290 - DNA, 61 bp, Homo sapiens
actgtgttgcctctaaatgtgatttaactcrcatattcagaatcttagcaaaaataaataa

SEQ ID NO: 1291 - DNA, 61 bp, Homo sapiens
tagattattacagctttgttgtcatattatytctaggcagtaaatcatagtaaagtagtaa

SEQ ID NO: 1292 - DNA, 61 bp, Homo sapiens
ttgccatcaccctagttctggccatcctcaytgaccacctgactttctgcctaaatggtct

SEQ ID NO: 1293 - DNA, 61 bp, Homo sapiens
taatatcttttaaaaaattaactgggcatgkcggtgcgtgcctgtagtctcacctacttgg

SEQ ID NO: 1294 - DNA, 61 bp, Homo sapiens
taatatcttttaaaaaattaactgggcatgtyggtgcgtgcctgtagtctcacctacttgg

SEQ ID NO: 1295 - DNA, 61 bp, Homo sapiens
aaaataaaattagaaaggataggtgtgtktgggagggagactggttaatcagggtgcatgg

SEQ ID NO: 1296 - DNA, 61 bp, Homo sapiens
ataggtgtgtgtgggagggagactggttaaycagggtgcatgggattatgtagggcttgtc

SEQ ID NO: 1297 - DNA, 61 bp, Homo sapiens
ggggtgggggtgtggtggggaagagggagrgggcgaggccaggggagggtgcgaaggaggc

SEQ ID NO: 1298 - DNA, 61 bp, Homo sapiens
ggggtgggggtgtggtggggaagagggaggrggcgaggccaggggagggtgcgaaggaggc

SEQ ID NO: 1299 - DNA, 61 bp, Homo sapiens
ggggtgggggtgtggtggggaagagggagggrgcgaggccaggggagggtgcgaaggaggc

SEQ ID NO: 1300 - DNA, 61 bp, Homo sapiens
cgcagcgcggcccgggccccacgatcctccycctgctcctcctactcctcctcctcctcgg

SEQ ID NO: 1301 - DNA, 61 bp, Homo sapiens
cgtggcctctccctccccctctccctcgccsgtcctcttcgccctgcgctctgagcgcccg

SEQ ID NO: 1302 - DNA, 61 bp, Homo sapiens
cgttgagtcgcgcggtgcttcccctcctggsggccgccgctcacctgggcgccgagtccta

SEQ ID NO: 1303 - DNA, 62 bp, Homo sapiens
cctgggcgccgagtcctaccgggcgcctacrcccagagctcagggcaagggacagcagtccc

SEQ ID NO: 1304 - DNA, 60 bp, Homo sapiens
gcagtcccggccgcaccctcccagagtccygggagcgcttcgctccctggcacggcccct

SEQ ID NO: 1305 - DNA, 64 bp, Homo sapiens
tgacttataaatgcttcagcttctctgttgcayggtgttctactactcttttactaggcgatac

SEQ ID NO: 1306 - DNA, 61 bp, Homo sapiens
ttctttctttttcaagtacatatttgctatkcagcaaaggattgaatgacttctcaggaaa

SEQ ID NO: 1307 - DNA, 61 bp, Homo sapiens
atttaaaatgtgcatattttattaagcaaayggcgtagagttatttggtttaattttctgt

SEQ ID NO: 1308 - DNA, 61 bp, Homo sapiens
ttatttggtttaattttctgtaagtaactcstaaagaattgtcctaaaagctgtgggtgag

SEQ ID NO: 1309 - DNA, 61 bp, Homo sapiens
ttccacctggccattggggaaatggaatttrttacaaatcagctgtacaaaaatagatttg

SEQ ID NO: 1310 - DNA, 61 bp, Homo sapiens
cagttcttttaaatttgtgtctggtgggggycaattatttaaatttctggttggcatttgt

SEQ ID NO: 1311 - DNA, 64 bp, Homo sapiens
gaaatatctgattgtctctcccatttcctcygcagctggagcaacggacacactgaaagcatcc

SEQ ID NO: 1312 - DNA, 61 bp, Homo sapiens
ttgactactaccggtaataaaatcaaatggrttcagtgctcacaactcttcagtctttggg

SEQ ID NO: 1313 - DNA, 61 bp, Homo sapiens
actactaccggtaataaaatcaaatggattsagtgctcacaactcttcagtctttgggcta

SEQ ID NO: 1314 - DNA, 61 bp, Homo sapiens
tattaacatgtgcatttgctttttaagaagwatacacacgtgtacctttagctttgaaagg

SEQ ID NO: 1315 - DNA, 61 bp, Homo sapiens
tgcctctggcatttaagtgccccatgtggcmtctgtcaccctcagatcttcccattttctt

SEQ ID NO: 1316 - DNA, 61 bp, Homo sapiens
cacattttctttatccatttatctgttgatrggcacttagattgcttccaaattttagcta

SEQ ID NO: 1317 - DNA, 61 bp, Homo sapiens
ctgtgtttttctaggtacttactatttctartgagttttgtacttttagataatttctgat

SEQ ID NO: 1318 - DNA, 61 bp, Homo sapiens
acttggtagtcccaagtgtctatttttgccktctttgtgtcattgagtacccattgtttaa

SEQ ID NO: 1319 - DNA, 61 bp, Homo sapiens
ttggaaacctggctacacagcaatgcctccrttgactagagtcagtcagttgcatgtttct

SEQ ID NO: 1320 - DNA, 61 bp, Homo sapiens
ctctgaactcatgtcttttgttttcctgggyttataccaatttcctttgcttttattttag

SEQ ID NO: 1321 - DNA, 61 bp, Homo sapiens
gttgaaatcatggttttaagaatccttattrtaactatgacaataaaagactgcatcatct

SEQ ID NO: 1322 - DNA, 61 bp, Homo sapiens
atagtaatatattttcaaaacattgtatttytgtatgttttgtctactaatgaaggtgttg

SEQ ID NO: 1323 - DNA, 61 bp, Homo sapiens
ggtctattctccctctactttgtatttctaractaatctagggtttttatattttgttaca

SEQ ID NO: 1324 - DNA, 65 bp, Homo sapiens
cttatcatatttgttagaatgcaatctagaraagcaaatattgactctttgaggatcaattccag

SEQ ID NO: 1325 - DNA, 65 bp, Homo sapiens
cttatcatatttgttagaatgcaatctagagaagyaaatattgactctttgaggatcaattccag

SEQ ID NO: 1326 - DNA, 61 bp, Homo sapiens
tacattcagtaagggcacaggaaacagagtyaatataaaagaatcaactggttccttgtgt

SEQ ID NO: 1327 - DNA, 61 bp, Homo sapiens
cccccagttggtcatagagtcagtatgatcygaataaaaatttcagcactcagttttgtag

SEQ ID NO: 1328 - DNA, 61 bp, Homo sapiens
accaagaattgctagatagctgatgaaattyctaaatgagatataacaactaaaaaagaaa

SEQ ID NO: 1329 - DNA, 61 bp, Homo sapiens
aaagaaatgtattgagaaggtatttagcgayatagggaagaacttgaagctgacttaggga

SEQ ID NO: 1330 - DNA, 61 bp, Homo sapiens
tagggataagtacataaaaagttaagcaaayaggggaaaaccagaaacaattgttagctcc

SEQ ID NO: 1331 - DNA, 61 bp, Homo sapiens
gtagtaaaaggtggggcctttggaagatgaktaggtcatgatgctaaagctctcatgaatg

SEQ ID NO: 1332 - DNA, 61 bp, Homo sapiens
acatttctttttctttcttctctttttcttyttctcctttttctccttctcccctccccct

SEQ ID NO: 1333 - DNA, 61 bp, Homo sapiens
agtttgcaaataactctcccttctccatgarggtaacttggaattcgatgtgtgtgtatgt

SEQ ID NO: 1334 - DNA, 61 bp, Homo sapiens
aaaaaaaaaattcatactttactagtgggckattattggaatatgaagcatttcagtttaa

SEQ ID NO: 1335 - DNA, 61 bp, Homo sapiens
tgtgaatgttgtcaagggcgccaaggatgckggacttgcatttagatgcccaagcctctgt

SEQ ID NO: 1336 - DNA, 61 bp, Homo sapiens
ggtaatggagaagcctcctccctcatgcccrtgctcttgtcaggcctgtttgttaaggtcc

SEQ ID NO: 1337 - DNA, 61 bp, Homo sapiens
gtaattttatggtttacaaagcatattgacwtccttgatttattcatgttgccagctgccc

SEQ ID NO: 1338 - DNA, 61 bp, Homo sapiens
gaaactctgtatattctgttacccagaagcyctctgaacccaatccttttgggtttttaca

SEQ ID NO: 1339 - DNA, 61 bp, Homo sapiens
gttaagtgtccttagagcatatttttatagyataaaaattgggaaaaaattaagataaaga

SEQ ID NO: 1340 - DNA, 61 bp, Homo sapiens
ctccctcactgagaagtctggaacatgccamatgttcacagtgaggctgttaaaacttcca

SEQ ID NO: 1341 - DNA, 61 bp, Homo sapiens
cccaggaggctctttgattcttcatatcacrttatttttacctgaggattgtagataccct

SEQ ID NO: 1342 - DNA, 61 bp, Homo sapiens
gggattagaagtccaggccagaagtctgaartcatcagcttgggttctgttgatgtgaagt

SEQ ID NO: 1343 - DNA, 61 bp, Homo sapiens
cagtaaaggagctgaaataagattttagttmattggtagccacacatgcccacaggctggt

SEQ ID NO: 1344 - DNA, 61 bp, Homo sapiens
agcaaggagaccagatgtggctattttaaamatttttcgttgatacataataactatacat

SEQ ID NO: 1345 - DNA, 61 bp, Homo sapiens
atttatttggttcacgtttgtgatgtctggmaaaattcaaaattgggcatctgtatttggt

SEQ ID NO: 1346 - DNA, 61 bp, Homo sapiens
aactgtatgtttttgcacattaaccaaactstcttcattcctcactccctcatccttccct

SEQ ID NO: 1347 - DNA, 61 bp, Homo sapiens
atactactgagttttatttgtgttcacattyagtgctatgttaaaaaattcacaaagtaac

SEQ ID NO: 1348 - DNA, 61 bp, Homo sapiens
aatgttaagaggtactataatagctatttasatggcagagttaggatttcctgtttctttt

SEQ ID NO: 1349 - DNA, 61 bp, Homo sapiens
ttacaatgctcttttagccctgccatctggrgatggcttaagtgttaaacagctcagtgaa

SEQ ID NO: 1350 - DNA, 61 bp, Homo sapiens
gctacagctgactcagtgagatgggaatgakgtcagaaagatgaggaaagggcagtccaga

SEQ ID NO: 1351 - DNA, 61 bp, Homo sapiens
tgacatgatctgacttcttttttaacaagayggctcttattgtatcattaacagcatggtt

SEQ ID NO: 1352 - DNA, 61 bp, Homo sapiens
cccttggccaaaagtaagcacgacctctctkgcattgtgaacaaaaagaggaattaactca

SEQ ID NO: 1353 - DNA, 61 bp, Homo sapiens
atgggatggctgcacagaggcacatggagawgaagcaaggaagccaccttcagcttctggg

SEQ ID NO: 1354 - DNA, 60 bp, Homo sapiens
tggggctttgtaaattggactgacaaagacrgcttaacaagagagaagcaggagtttatt

SEQ ID NO: 1355 - DNA, 61 bp, Homo sapiens
tgaataatcccttaggacagggttgcctgakgaaatgggggacacccagtcaaattggaat

SEQ ID NO: 1356 - DNA, 61 bp, Homo sapiens
aaagagaaaaaacagagtcaatgcggaaaaygctgccaagacaacattttcttcttaagat

SEQ ID NO: 1357 - DNA, 61 bp, Homo sapiens
ctaggatgagaccagaaggggtcattttaaygagattttcagatgactttgaatttatatt

SEQ ID NO: 1358 - DNA, 61 bp, Homo sapiens
caaaatagagataaaaaagactttatctcastaatgtgtcatgcaaataaggattaatcct

SEQ ID NO: 1359 - DNA, 61 bp, Homo sapiens
cgtgcttagaaactacccctgttaaatactkaatatataacatttgtaatgttcaaatacc

SEQ ID NO: 1360 - DNA, 53 bp, Homo sapiens
gccaaagacttttgcaatgagctaactrtgttcaattattgctttcagatcca

SEQ ID NO: 1361 - DNA, 60 bp, Homo sapiens
gttttatgttttaatggaaacatttcatgtytagagaataatgatgcttaaaatttatat

SEQ ID NO: 1362 - DNA, 59 bp, Homo sapiens
agacagagcttaaaggcctctgtttgttgsgtcactttaaaaacaaaccctactgccag

SEQ ID NO: 1363 - DNA, 64 bp, Homo sapiens
catgagggtaacagcccccatcgttcrttcaattacctccgaccaggtcccttccatgacacat

SEQ ID NO: 1364 - DNA, 59 bp, Homo sapiens
gtacatctgtagtctcagctacatgaaggckgaggcaggatgattgtttgaccctggga

SEQ ID NO: 1365 - DNA, 58 bp, Homo sapiens
gctcaaaaaaagttttaatttattggtgactkagctgggtaaaggttggccattacat

SEQ ID NO: 1366 - DNA, 89 bp, Homo sapiens
gacttagagatatgtttatattacattgtcaagtgaaaagtgttgtataatayatgtgtgattgacttttctttctttgcttttccttt

SEQ ID NO: 1367 - DNA, 558 bp, Homo sapiens
gacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaarataatcaaaaaaaaataaatgctccctttcttatgtccaggaaacagcggaaaaagctgcatgaccgtcttcggcagagccttcggtctgaacgaaacaatacgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagctttta

SEQ ID NO: 1368 - DNA, 558 bp, Homo sapiens; identical to SEQ ID NO: 1367

SEQ ID NO: 1369 - DNA, 554 bp, Homo sapiens
ggtgtcctttgctatgaatgttcaatgaggcgttctgagatcaccaagaatagaagagacacacccccggctgtcagaagtttaaccttggagaatgccatgaagggcaattctggaagaaaaaagagaagggaattcctcgtaggtttaagatcagaaagtggggaaggcgggggtgctcttaaatgcatcagccctactgccagcacagtggggactattaacacatcatattttttttttcctgcagttactcaaccttkcagtgggacaagttgctcaatgacttaccaggagacaattgttatttttaaaaatgtctttcttattttaactacaaggacttggcttgcttagaggctcttgctcaggagtctttaaatgcaaatgagggaaaccccaggttataaagcatctgcttctgcaggttttcaatcctgttaccttagcaacatttgcccttgtattccacgcatcaccttgacagcctgcataatataagggacggagcggagcaggggctcggggtgggagcctggaaagaaaactggggc

SEQ ID NO: 1370 - DNA, 401 bp, Homo sapiens
tgaatgcaaaaatatgtctccacagaagcattagcataatttactgtacattcaatgaaattaagacagccaataaggaatataattcttatttattttgaaatgatggtaacaaatggctttgttaccttcaagcttcttactggcttaagctcttttaaaattctatggactatataagctactcaattttaagttttyatttttgaattcaagcttttttggttaggtaaagaatagaagtaactaccataaagaagaaaatataatcatctaatttctcctgaactctgtataacattggccattaatctacatcaatatatggtgaagatatgtaagcagaatgtacaatgtataagacatgcatatatcaatataaggtagtaatgtttatttta

SEQ ID NO: 1371 - DNA, 401 bp, Homo sapiens
aaatggctttgttaccttcaagcttcttactggcttaagctcttttaaaattctatggactatataagctactcaattttaagttttcatttttgaattcaagcttttttggttaggtaaagaatagaagtaactaccataaagaagaaaatataatcatctaatttctcctgaactctgtataacattggccattaatcyacatcaatatatggtgaagatatgtaagcagaatgtacaatgtataagacatgcatatatcaatataaggtagtaatgtttattttaaattccgcagatccatttagattcctttggttttatatttggtctattttgttactgcctctataattctgcttatttatttcaaattttacaacatctatttctcctttgag

SEQ ID NO: 1372 - DNA, 401 bp, Homo sapiens
aagctactcaattttaagttttcatttttgaattcaagcttttttggttaggtaaagaatagaagtaactaccataaagaagaaaatataatcatctaatttctcctgaactctgtataacattggccattaatctacatcaatatatggtgaagatatgtaagcagaatgtacaatgtataagacatgcatatatcaatrtaaggtagtaatgtttattttaaattccgcagatccatttagattcctttggttttatatttggtctattttgttactgcctctataattctgcttatttatttcaaattttacaacatctatttctcctttgagaaaacgtagacaactgatattgggatagagtttaaattgtgagaaatattcagttacagtaaaag

SEQ ID NO: 1373 - DNA, 401 bp, Homo sapiens
aaatgcattagaactagaacttgcgtgattttaaattttattagaagtaggtgtcaagttacctaagatgtccaagagacagctgatgggttatgagttaaattttgggttctgcttatcatttcttagaaatcaatttaaggcatcagttttcaatagcttttttatgtataactaaaaaagagatatatgatatttggyaaaataaagatacatggcttccagtctcttgagacatctgtcttcatgaaagagatggagagttcccatttctacttacaagaatgaatgtatgtcataataaagaccagctatcatttgttatatacaaaatatgtggttctttctttgactttttttctggatttagacaaccacagatgacatttatgagaaatgaa

SEQ ID NO: 1374 - DNA, 401 bp, Homo sapiens
agttacctaagatgtccaagagacagctgatgggttatgagttaaattttgggttctgcttatcatttcttagaaatcaatttaaggcatcagttttcaatagcttttttatgtataactaaaaaagagatatatgatatttggtaaaataaagatacatggcttccagtctcttgagacatctgtcttcatgaaagagayggagagttcccatttctacttacaagaatgaatgtatgtcataataaagaccagctatcatttgttatatacaaaatatgtggttctttctttgactttttttctggatttagacaaccacagatgacatttatgagaaatgaactacactgaattcaactgagaaagtagaagattctgtatctccattaacttgtgag

SEQ ID NO: 1375 - DNA, 425 bp, Homo sapiens
tcttcattgcaatgctgtggtctcctgagttggttttgtctatgcagtgcaggaagaatctgttggctggttacaattttatattaagggagggtacccaagagaaaattctagcccatttctattgcttcatttttcacattgcatgcagtcagtggtgatgtactttctctctctctttttttagagagagagttcctttttttttttttttagagagttcctcattacttgttttgaacctaaasttataatttagtgtctgtgacagcacatttgattgtttttaaatgaaggtgataggaaaggcagaagaatgactagggaagaaaatctggagaacagatgacaagataacattgcttttgattctctgcaaacaagcatggtattgaaaaatgatccaaaatcgtttgcttgagcac

SEQ ID NO: 1376 - DNA, 401 bp, Homo sapiens
tatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgcctttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaag

SEQ ID NO: 1377 - DNA, 714 bp, Homo sapiens
gaccagatcttacgagaactcggtcactatcatgagtacagtaccaagagggatggtgctaaaacgttcttgagaaatctgcccccatgattacaatcacctcccaccagagcccacctccaacactggggattacatttcaacatgtgatttggtggggacacacatttaacccatatcaactactaagctcattcttttttttttttttttttttttgagacggagtctcgctctgtcgcccaggctggagtgcagtggcgcagtctcggctcactgcaagctccgcctcccgggttcacgccactctcctgcctcagcctcccaagtagctgggaccacaggtgcccgccaccacgcccggccaattttttgtatttttagtagagacagggtttcaccgtgttagccaggatggtctcgatctcctgacctcgtgatccgcccgcctcggcctcccaaagtgctgggattacaggcgtgagccaccgcacccggcctaagctcattctttaaaaccttataaatacacccattcagtcctagccagcgtggccacacaatgtaagattctctctctcttctgttctctctctctctctttcactgacctttacaactttctatatcaactcacatttttgtcctttattttcgtctttcttatttaaatgacctctaaactactctaggataaaagtcactgtcattttt

SEQ ID NO: 1378 - DNA, 401 bp, Homo sapiens
ctctccctgtggcacaccctgtgaggggsacaagggaacttttcccattttactaccaaggccagtgacatgaatgatcaaatacyaaccagctacattttatttaatttttaatttttttagttgtcagaagattttattaactgtaagccagggaatggactgatcgattttattatgcaaatcaatgaaaaaaaaaaactcttttagaaggacacaaacacacacacgtgctcacagggaagctggttgttggttgagagtcaggtcagaaccttggagagctcaagataaagcgggggcagaaccacaatcagaagcttccatggctgccccccacatggatgagttttatttaattatttttttccttcaacttttattataagctcaggggtaca

SEQ ID NO: 1379 - DNA, 404 bp, Homo sapiens
ccctgtgaggggsacaagggaacttttcccattttactaccaaggccagtgacatgaatgatcaaatacyaaccagctacattttatttaatttttaatttttttagttgtcagaagattttattaactgtaagccagggaatggactgatcgattttattatgcaaatcaatgaaaaaaaaaaactcttttagaaggacacaaacacacacacgtgctcacagggaagctggttgttggttgagagtcaggtcagaaccttggagagctcaagataaagcgggggcagaaccacaatcagaagcttccatggctgccccccacatggatgagttttatttaattatttttttccttcaacttttattataagctcaggggtacatatgcaggatgtgcaggtt

SEQ ID NO: 1380 - DNA, 401 bp, Homo sapiens
attttatttaatttttaatttttttagttgtcagaagattttattaactgtaagccagggaatggactgatcgattttattatgcaaatcaatgaaaaaaaaaaactcttttagaaggacacaaacacacacacgtgctcacagggaagctggttgttggttgagagtcaggtcagaaccttggagagctcaagataaagcgggggcagaaccacaatcagaagcttccatggctgccccccacatggatgagttttatttaattatttttttccttcaacttttattataagctcaggggtacatatgcaggatgtgcaggtttgtgacataggtaaacctgtgccatggcggtttgctgtacagatcttcctgtcacctaggtattaaacccagcaccc

SEQ ID NO: 1381 - DNA, 405 bp, Homo sapiens
attaaaagatgttcttcaggcagaaaaaaataatatatcagactgcaatgtagacctatacgaggaaataaatttcattctttctttaagatactgactaccctaaagctgtctcacctagagccctttccctcaacttttcttttcttttctctctctctctctcccttcctttctgtcttctcttctcttctcttttcttttcatttcttttctttctttttgacagagtttcactctgtctcccaggctggagtgtgatatcggctaactgcaacctctgcctcctggcttcaagagatccttgtgcctcagcatcctgagtagctggaattacaggtgtgtgccaccatgcctggctaatttttgtattttcagtagagtcggggggtttcaccatgttgg

SEQ ID NO: 1382 - DNA, 401 bp, Homo sapiens
caaggcagtggcaagaatggctatcccagttttgggtcaaaacaagtgacaactaacaagacagagaacatatttatgcttgctactttaatgtttggtctcattatcttattagatatattgaacgatatttgtaaataggcagggaaaattgaagctttgtgtgtgtgcgtgtgcgtgtgtgtgtgtgttttattataaggtagcttttawagcaatgggatttcttctcataacagggtagaaggggcatggttccttccccattctgaagctttgtgttgtttttttgcttttttttctagtataaagagttcaattagggtaactctgccccttacctcatttgtcctggtgatacgtatgaaataacaccaatttgctagttagattaattgtga

SEQ ID NO: 1383 - DNA, 401 bp, Homo sapiens
tggctatcccagttttgggtcaaaacaagtgacaactaacaagacagagaacatatttatgcttgctactttaatgtttggtctcattatcttattagatatattgaacgatatttgtaaataggcagggaaaattgaagctttgtgtgtgtgcgtgtgcgtgtgtgtgtgtgttttattataaggtagcttttawagcaatgggatttcttctcataacagggtagaaggggcatggttccttccccattctgaagctttgtgttgtttttttgcttttttttctagtataaagagttcaattagggtaactctgccccttacctcatttgtcctggtgatacgtatgaaataacaccaatttgctagttagattaattgtgattagtgattagattaat

SEQ ID NO: 1384 - DNA, 401 bp, Homo sapiens
gttttgggtcaaaacaagtgacaactaacaagacagagaacatatttatgcttgctactttaatgtttggtctcattatcttattagatatattgaacgatatttgtaaataggcagggaaaattgaagctttgtgtgtgtgcgtgtgcgtgtgtgtgtgtgttttattataaggtagcttttawagcaatgggatttcttctcataacagggtagaaggggcatggttccttccccattctgaagctttgtgttgtttttttgcttttttttctagtataaagagttcaattagggtaactctgccccttacctcatttgtcctggtgatacgtatgaaataacaccaatttgctagttagattaattgtgattagtgattagattaattgtgtgcactc

SEQ ID NO: 1385 - DNA, 401 bp, Homo sapiens
aacaagtgacaactaacaagacagagaacatatttatgcttgctactttaatgtttggtctcattatcttattagatatattgaacgatatttgtaaataggcagggaaaattgaagctttgtgtgtgtgcgtgtgcgtgtgtgtgtgtgttttattataaggtagcttttawagcaatgggatttcttctcataacagggtagaaggggcatggttccttccccattctgaagctttgtgttgtttttttgcttttttttctagtataaagagttcaattagggtaactctgccccttacctcatttgtcctggtgatacgtatgaaataacaccaatttgctagttagattaattgtgattagtgattagattaattgtgtgcactccacttcttcttg

SEQ ID NO: 1386 - DNA, 398 bp, Homo sapiens
agtgacaactaacaagacagagaacatatttatgcttgctactttaatgtttggtctcattatcttattagatatattgaacgatatttgtaaataggcagggaaaattgaagctttgtgtgtgtgcgtgtgcgtgtgtgtgtgtgttttattataaggtagcttttawagcaatgggatttcttctcataacagggtagaaggggcatggttccttccccattctgaagctttgtgttgtttttttgcttttttttctagtataaagagttcaattagggtaactctgccccttacctcatttgtcctggtgatacgtatgaaataacaccaatttgctagttagattaattgtgattagtgattagattaattgtgtgcactccacttcttcttgc

SEQ ID NO: 1387 - DNA, 410 bp, Homo sapiens
aatatattagtagggcatggtggcatgcgcctgtcatctcagttagtcaggaggttaagttgagaggatcacttgatcccaggagggtgaggcttctgtgggctgtgattatgccactgcactctagcttgagtaacagagcaagaccctatctctaaaacaaaacaaaacaaaacaaaacaaaacaaaacaaaacaaaacaaaacaaaaggctaatgagcattaaacctacagaaaggaatctgagcagaaaaagccaatggtcaatgatagggaatcctgatttcttactgacacccaaaacactaataaatctcttgatgatgtatgagttgctgttaccttgcacagcagtgagcagttctatatggcaattgctcagttagctctcaacttcctgaacagcagtt

SEQ ID NO: 1388 - DNA, 402 bp, Homo sapiens
kacaagcagccaracccttttgccaakyacatgcccattatgaggcytatggaaaatgttgtgattaaagkagttcsttttccatgggcaccccatgtgtacttstgcwaaatggamcartagcttgmaaagccktaccagatkwgctgtstcagcttmcccwgtgggtcttactgatcaaggacattatagtaaataaaaaawaaaaatgagagagmcaaagaagagagtcatggacttgtcccagcagggtaggagtctttagatggttattgagaaactggatgaatgttgtggatattgatggtgttgaaacaaaagtattaatgcagcactattgaaggttagatgaaccaatgggactttctgtttgtctcccaacattgaaaggctccaacaagt

SEQ ID NO: 1389 - DNA, 450 bp, Homo sapiens
tcaacaaacaatgctgggcactgctaacacccagcccaggggaaagggcttgtaccctgacccaataggacctcttgactattttaatacagatggaagctgaagtggccatggggcagtgacctgctattctggctgctgaggtccaagagacccacccatgggagtctgatggccttccaaacttatggaagttctctgagggcacttgtagttttacactgatagactatgaatgctctcacccacagcatagatcaaaatgaaatacatcctgcagtacagttggtagaaatgggaaccactctgaataccacctgtgtcctccctgcaagaaggaggtgggccttgctatctaataatacacaatggaaaccagcctcagtacaagcctgtgagatgaggtggggtggttctttttgtcctcaattaactagaaacccagatata

SEQ ID NO: 1390 - DNA, 412 bp, Homo sapiens
cattgcacagtgataagtcactgcatgtgcgacagcagagaatgagccccgcctgggaaatagcctgtatctttccacttgtcctgactgattaacaatttatgctgcatgagtagaaaataattttgacctcattcactttattgcttgtgaaatcatggcagtatccatagactttttgcttaaacatttatattagtaggcatttttgtgttttcacatggctgcatgaaatgaacaggcacttttctaatatgaacatacagtgaatgaattaataactgtatgtttctaagagccacatttctgttagaactagccatataaggcatatgactaatgaattcagatatttaatattgaagtttaggaaaatgtcatttccactgggctgagaattagagtcaggagc

SEQ ID NO: 1391 - DNA, 404 bp, Homo sapiens
tggaggtgagggagggtgaaaatgtgcaatagatgatgacagtgttggagaaggcagaggtttttgccataaagaatctctagctgggatcacttgaggccaggagtttgagaccagcttgggcaacaaagtaagaccccagctctataaataaataaataagtaaataaataartaaataaataaataaataaataaataaatcagctgggcatggtggtgtgcatctgtagtcccaactactcaggaggctgaggcagaaggatcccttgagcctaggagttcaaggctgcagtgagctatgatgtgccactgcactccagcctggggaacagagcaagatcctgtcttttaaagaggaagagagagagactgactccattgggctttttctttttcacgtt

SEQ ID NO: 1392 - DNA, 404 bp, Homo sapiens
tctggcagaaaatgcatacagagagagaactcagcatgggagtttcttgtattttcaaatgacttctaattcctggttactccatgcacagaggttgtactcctggagagcttaaaggtaacaaatagctttgatggaatgtggctgcaaagatattaaccttcctacagaagagagattagcagcagacatgtgcctattgtgtgtgtgtgtgtgtgtgtgtgtgtataaaatcagtatgttcaaataaactgtctgggttgctgctttggtttgtgctaattattttgttttcaaagttttaggaaagaactccatttatattgttttaaagaaaaaacaaagattgactgaggtaaacttggagtaagtataggcataatcaaatagggtcccctagatca

SEQ ID NO: 1393 - DNA, 401 bp, Homo sapiens
accatcctggctaacacggtgaaaccccgtctctactaaaaatacaaaaattagccgggcatggtggtgggcgcctgtagtcccagctactctggaggctgagacaggagaatggtgcgaacccgggaggtggagcttgcagtgagccgagatcgcgccactgcactccagcctgggcgacagagcgagactcactctcmaaaaaaaaaaaaaaaaaaaaaaaaaaaggaaccaagttgtgagtgagaaggacctggaaaggcactgttagtggcagtggatccgtaggggtctgcaggaacctcaactcttgcgtcctcagaagaattcgacggaggaggcatgaggcagaaggagagacagaggcaagttttatagcagaagtgaaagtttatttaaaa

SEQ ID NO: 1394 - DNA, 401 bp, Homo sapiens
tataaggaagggatccagtttcagctttctacatatggctagccagttttcccagcaccatttgttaaatagggaattgtttccccatttcttgtttttgtcaggattgtcaaagatcagatggttgtagatgtgtggtattatttctgagggctctgttctgttccattggtgtatatctctgttttgktaccastacyatgctgttttggttactgtagccttgtagtatagtttgaagtcaggtagtgtgatgcctccagctttgttcttttggcttaggattgtcttggcaatgtgagctcttttcagattccatatgaactttaaagtagttttttccaattctgtgaagcaagtcattggtagyttgatggggatgtcattgaatctataaatta

SEQ ID NO: 1395 - DNA, 404 bp, Homo sapiens
tcttctcaaggagtatctttgtggcgttctctgtatttcctgaatttgaatgttggcctgccttgctagkttggggaagttctcctggataataccctgcagagtgttttccaacttggttccattctccccatcactttcaggtacaccaatcagatgtagatttggtcttttcacatagtcccatatttcttgaaggctttgtttgtttctttttactcttttttctctagacttctcttctcacttcatttcattcatttgatcctcagtcactgatatcctttgttccagttgatcgaatcagctactgaagcttgtgcattcattacatagttctcatgccatgtttttcagctccatcacgtcatttaaggactcctctacattggttattctagtta

SEQ ID NO: 1396 - DNA, 426 bp, Homo sapiens
actttaaaatatttagagaataaatgtttaagaatattttacagggtaggggaaaatttcttaagcaatcacatgtagcataatgtcaaaatggaaaggctgataaattagatttaaacaatctaattttaaattagatttaaacagtctaattttaaattagatttaaacagtctaattttaaattagatttaaacagtctaattttaaattagatttaaacagactaattttaaattagatttaaacagtctaattttaaattagatttaaacagtctaattttaaattagatttaaacagtctaattttaaattagatttaaacagtctaattttaaattagatttaaaaaattaaggccttttcttcgttcaaagatactttaaattttgtaaaaaataagcatcaaattgaaagaaatttg

SEQ ID NO: 1397 - DNA, 404 bp, Homo sapiens
tgcttataccatgatattttagtattccctcttgccttctccatttttcaatatctggtcggatagcaattctttatattgaattatttctgtaaaaataactgttggggtttctattctatatcttagatggactctaactgaattaatacatatgtaaatatatggtgaatatatataaattataaacatatgtctctatatgtatatatagatatgtgtctctatatcaatgtatgtattatagatatatacatatatgtatatatagaaccatagataattctccttaatatgcatgtacatagatatgtacatccatattatatgatatagaatatataaatataatatctaatatatgcatattaaggagaattatctatggttctaaatatgcrtta

SEQ ID NO: 1398 - DNA, 401 bp, Homo sapiens
aaggtttccactgaaaagtctgctgctaggcatattggctctccattgtatgttatttgtttcatttttcttgctgcttttaggatccctgctttatccttgatctctggcagattgattattaaatacttgccattttgagtctattttctagatcctgtaggtgtgcttcattgttttttattatttttatttttttttctcttgyctcctctgtgtatcaaatagcttgtcttcaggctcacacgttctttcttttggttgattaattttgctattaaagkactctgctgtatttttcattatgccaattgcatttttcagcttcagaatttctgcttgattctttttaattatttcaatctctgttaaatttatctgataagattctgaattccttc

SEQ ID NO: 1399 - DNA, 405 bp, Homo sapiens
tctgaccactgccctatcctgctatggctgagctggtatccaagatccaakacaaagtcctcccaacttttccctctcctcttctgaagtggaagaaagggatttcttttcgagctgtgagctgtgaagcctgggggtaggggaggggtgatgccggcactcctttatccacctcagctggtgtctcagtatgtcatgtgccccccccccccccccccagtccactgtttcaggacctggttcagcactgggactcacctaattgttgcagaccttatggactacattggctttcaagtttgtttggagacacagagcactttggtcactggtagtgaggtttgcaggaactcaagttctgacctctgggatccatgatccctctctgagtagtgccggtttaaa

SEQ ID NO: 1400 - DNA, 405 bp, Homo sapiens
tgttctctctcctctagcacccagagatgctctctgcaccatgccatgacttccagggggtggagaacaggtaatgtcaggggttcagggctcttttttctatctcttcagttgcctctttcagtgatatgaagttaaaaccaggtactatgagtgctcatctgatttttggttcttatgaagctgtttttttttttttttttttctgtgtagatagttgttaaattggtatctttgtggagaaggcaatcagtggagccttctgtkcggccatcttgctccttatacctgctactttgtattctctgatctatgtctcttcatttctccactcctctgttccaaccacccctggtaaccatgtttgtcttctctatttctgtatatttatttacttattttaga

SEQ ID NO: 1401 - DNA, 415 bp, Homo sapiens
ttaaatctttaatttgtcttgagttaatttttgcaaatggtgaaagatgggggttcagttttattcttctgcatatggctagccagctgttctaacaccatttgttgaataaggagtcctttccccattgcttctttttgttgaccttgtcaaagatcagatagctgtatacatgtagctttatttccgggttctttatttccgggttctttattctgttccattggtctatgtgtctgtttttgtatcagtaccatactgtttgggttactgtagctgtatagtatagtttgaagtcaggtaatgtgatgcctccagctttgttctttctgcttaggattggtttggctattcaggctcttttttaagttctgtatgaattttagaatagttttttttctagttctgtgaaaaa

SEQ ID NO: 1402 - DNA, 414 bp, Homo sapiens
gataaatttattacttttgttctttccttagtggacgtaataataattactactactttttgggcattacttctctgcttgtgatacggctctggcgagtagaggaacactagggctcttgtctcatgttcaattagataaaacaacatggacacacttggagtggttttaaggagcagagggtttaataggcaagaaaaaaggaagaagaaagaaggaagaagctcccctatacagagacagaggaaggggggctccaaagccaagagagggaaccccaagtgaagcagaaaccagccatgtgtatacagaggctggaggaggtggtgtctgatttgcacagggctcgggggattggtttgaccaggcatgtgattcacatagcctgggaaaaagctggccttcccaccctag

SEQ ID NO: 1403 - DNA, 414 bp, Homo sapiens
accccgtctctactaaaaatacaaaaattatttgggcatggcggcacatacctgtaatcccatctacttgggaggctgaggcaggagaattgcttgaacctgggaggtggaggttgcagtgagccaagatggcgccactrtattccagcctgggtgaaagagtgagtgagactctgacacacacacacacacacacacatacacacacacacacacacacacacacacacacaaagtagtaagcactcaggagttcgataaccacctttatgttgatggcttctaaatctctgatatcagtccagatccttttcttgacctcaactacagggccaactaactactagatttctcaaacactattaagacagaactcttcacctctcccaggtctccaaatttattcttcctctc

SEQ ID NO: 1404 - DNA, 433 bp, Homo sapiens
cttagaaaatatacccccaaaaagcttcagtttcaattagctgggcgtgatagcacgygcctgtaatcccagctactcgggaggctgaggcatgagaattgcttaagcccagaggtggaggttgcagtgagccaagaatgggccactgcactctagcctgggcgacagagcgagactccgtctcaaaaaaaaaaaaaaaaaaaaaaaaaaaaaaaaaaaaaaaaaaaaaaaaagaaatgaatgygcatatgactaccatcctaatataaatggagcttatgccagtactatttgcagtagtactacttgaaataatgctcacaataaattttatgcttattaaatagtaattatacataatatagaaagtcaaatagtgctacaaaacttacaataacaacactcattaacttgacccccttccaaatctgat

SEQ ID NO: 1405 - DNA, 412 bp, Homo sapiens
attcattcattcattcattcattcaacaatatttattgaataattatgatatgccagggactaagatagatgctggagatagacacaaacccctgcccttcagtatcttatcttctaatggttgaaggcaggtatgggattgcaagtaccaaaagatgggtgatatcaattttttgtttttttgtttttttttgagacagagagtgcctggtacatagtaagtgctcaaaagatggtgcctaaaaggatggaccaagtgttacacaagtcatattctatttggttaatacacttctccacttctgagaaacatattattgttaaagttaaggtagattaattatgttaagaataaatggtctgggcatggtggctcatgccctgtaatcccagcactttgggaggccgaggt

SEQ ID NO: 1406 - DNA, 404 bp, Homo sapiens
agtgagacctaattaaactaaagagcttctgcacagcaaaagaagctatcaatggaataaaaagataacctaaagaatgagagaaaatattcacaaactatgcatctgacaaagatctaatatccagaatttataaagaactaaaataattcaacaagtagaaacaaataatcccattttaaaaattgggcaaaagacataaagaaacacatctcagaagaagacatgcaaatatccaacagatatatcaaaaaatgctccacatcactaatcataagagaaatgaaatcaaaaccacagtgagataccgtattcatctgttctcatgttgctaataaagacataaccaagactgagtaatttataaaggaaaaaggtttagttgacccacagttcagcatggt

SEQ ID NO: 1407 - DNA, 404 bp, Homo sapiens
tcactcggttgcccaggctgcagtgccttagcacaatcatagctcactgcagcctcaagctcttaaggctcaagggatcctcccacctcagcctcctgagtagctgggaccacaggtgtgcaccactgtgtctggctcctattacacagaacattttacttggttttctcactgattttgtgatgttgtcctaattmcatagcgctggcacaaagattatataagcagtagggtactttgtggactcacgtgtggccaggtttgtcccaggatcttcaccctttcactcccttacttgtgactcaccccagcctatacagtgggaagaaattgaggtggagttgaagggattcatagaggtaatgaccccttggattgctggggagggctgtggcaacatcctc

SEQ ID NO: 1408 - DNA, 406 bp, Homo sapiens
ggaaggggaacatcacactctggggactgttgtggggtagggggaggggggagggatagcattaggagatatacgtaatgctaaatgatgagctaatgggtgcagcacaccagcatggcacatgtatacatatgaaactaacctgcacattgtgcacatgtaccctaaaacttaaagtataataataataataataataataataaatgtttagaaaaaaattctatcataaatatgaccatttaatttcctacaagtttttcaaaagtttcttcttgggtttattcatccctatggaaaattccttagagagatttargaatcttcagtgaatacttttagaacaaatggaaagaaagcaaaaatgctgtttcatcattgagaaaaataaaactcaaaacaagct

SEQ ID NO: 1409 - DNA, 401 bp, Homo sapiens
aaaacttgttttgtggctgcatagtattccatggtgtaggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtgggggtagggggggagggatagcattaggagatatacctaatgtaaatgacgagttaatgggtgcagcacaccaacatggtgcatgtatacatatgtaacaaacctacacgttgtgcacatgtaccctagaacttaaagtataataaacatatatatatatatatatatatatatacatatataaacttgttttgtgaattttgaaatagtttt

SEQ ID NO: 1410 - DNA, 403 bp, Homo sapiens
catcacacaccggggcctgttgtggggtgggggtaggggggagggatagcattaggagatatacctaatgtaaatgacgagttaatgggtgcagcacaccaacatggtgcatgtatacatatgtaacaaacctacacgttgtgcacatgtaccctagaacttaaagtataataaacatatatatatatatatatatatatatacatatataaacttgttttgtgaattttgaaatagttttacacatacataggcattgcgataatgctacggacagttcccacagtccctgttacctagtgtccatcatggaaagcatataacgtaatcatagcacaattatcaaaaccaggaaatcaacattggtaaatgctattaactaaaccatagatcttttccagat

SEQ ID NO: 1411 - DNA, 403 bp, Homo sapiens
tatagaagctcagtgatctttttattctgttttactcaggctattctgtattcaggtaggatatctatcacccttactcttctctaaccccatcttaaaaaacaaagcggcggggagtttttcttttgatatcagcaacagataaccaaataagatggcgtataatcctttttttttttttttttttttttttttttttttttgagatggagtctcgctctgtcaccgaggctggagtgtggtggcactatctcagctcactgcaagctccgcctcctgggtccacaccattctcccgccttagcctcccaagtagctgggacgacaggctcccgccaccacaccaggctaattttgtttctgtatttttagtagagatgggggtttcaccgtgttagccagg

SEQ ID NO: 1412 - DNA, 407 bp, Homo sapiens
tgttttatgtctgtgattgtaagcttttagcagtttctcttcttctatttctttttttttatattttttattatactttaagttttagggtacatgtgcacaacgtgcaggtttgttacatatgtatacatgtgccatgttggtgtgctgcacccattaactcgtcatttacattaggtatatctcctaatgctatccttcccccctcccccctcccccctccccccaccccacaacaggccctggtgtgtgatgttccccttcctgtgtccaagtgttctcactgttcaattcccacctgtgagtgagaacatgcagtgtttggttttttgtccttgcgatagtttgctgagaatgatggtttccagcttcatccatgtccctacaaaggacatgaactcatcatt

SEQ ID NO: 1413 - DNA, 404 bp, Homo sapiens
tcctaaatcctaatttagctgtgggaagtttggatcaatggaaattaaactccatatatgccaacactatgggttgataacctcttccaagaatcattgcctgaccatcatgttccttctacctgaccactccttcctgcacttttatcacatattactctaagggatcatgtctaactttttgtcttcctcaattagactgagtatttcttgaggccaggaaatgcatcattttatccatagcatctaactcaatatctaatgtgtaataaactcttaatagaaatttacttaataactagatagatagtttaagatatgcccttgatgtagtcaagaagacaaaatgtatgggtacatttccttcttgtgtctggttcctctttctgcattgtcagggcaag

SEQ ID NO: 1414 - DNA, 404 bp, Homo sapiens
aaacattttcagaaaaaaagttgctgtgtttccgggagaagcagatggctgctattgagagacacctaggtttgtgttctgggaatctgtctcctactcatgatagcagggggcagattcagatctgcaggaggtagaaataggcatcagatcactctgtcctaaaaaacaaacaaacaaacaaacaaacaaacaaacaaacaattggaagaaatgaattgatcacagaagcatctagagctaggaccaattaaaagtcagttagtttatatgacctatttgaagatttctcaacaatcttgacctattgcttaagagcacaacatttgtagtaaaatgagcctaagttaggatatgacttaagatcactgaccagctgtctaagcttgttagggttacccaat

SEQ ID NO: 1415 - DNA, 527 bp, Homo sapiens
atgattttggtgctttaaaatgaacttgttttattgcttatcatatggtccaattttgttaaacattcaatttgccctgggaagtaacatgcattttgcttattttaaaagcagtgcattataaatgcaaattaaggcatttatatataatgacatatatatgtgtgtgtgtgtgtatacatatatatgtatacatatatacgtatatatacatatatatgtatatatacatatatacatatatacacatgtatacatatatatgtatatataaaatgacatatataatgacttacatatattgactggcaatatccctactggtatttgcttttgacttgtttcmtcagctactgggagaggtatgtcaaaatctcaaactttggttgtgaatgtactattctttataaaatttaaaactgtgttattaggtctataaacattaagaatgtttgtatatttttggtgtaatgacccttttatcagtatttttttcatatttatctctagaaatgctttgaagccta

SEQ ID NO: 1416 - DNA, 404 bp, Homo sapiens
atgaagatccaaaggcataagaatgatacattggacttcggggacttgcagggaaagtttggggactggcgaaggataagagaatattcactgggtacagtgtacactgctctggtgatggctgcaccaaaatttcagaaatcactactaaaaaacttactcatgtaaccaatcaccccctgttccccaaaaacctattgaaataaataaataaataaataaataaattgaatgaatgaaccaaaggtattgcacgaggaagcaacataaataaacttagtgagtgaaacagtgaagaaaggggcaatgtgatggtggtgataggtatacaggttaccttgttcacccttttaatactgtggataaacagaatcaagtaatttgttcagctaactagattccat

SEQ ID NO: 1417 - DNA, 404 bp, Homo sapiens
cctgcaaggcgctaacagtgaactttctatccaaaaagatagaaagaagttgtctctggttttgaacaatgaagatttatatctaacttatattgaaaaatcaaaggattagattttttaaactgaataagaaccatagctgtacttagagaatatctgtgatgcacttggcactgtgataagatgtgatgtatatcactctttatgattacaccaaccctgaatggcacttattttcaggtgtgacactagcctatggcggctgtcatgagrattagaaaatggtgtcccctccaggaggatactgcctgtgcctgagaatagagcacaggctgcatctaaggacccactgaccttctaggccagatatctttgtgtgtggcagagcctgcctaaatgtacat

SEQ ID NO: 1418 - DNA, 402 bp, Homo sapiens
gtctctagtaaaaatacaaaaaaattaactgggtgtggtggtgcattcctgtagtcccagctacttgggatgctgaggcaggagaatcacttgagcccaagaggcaaagttgcagtgagccaagatcatgccactgcgctccagcttgggctacagagtgagactccatctcaaaaaaaaaaaaaaaaaaaaaaaaaaaaaactactacttatcaaggaatgttttgaatgctttaattctttgacttaaattactatatwtatttataaaggtgtagaagatttracaactggaatgtgtgtgtgcgcatgcacatatacacacatatgcacatatgtatatatgtgtatgtataacatatatatctataaataaaagttatttaccaaagcatcatatat

SEQ ID NO: 1419 - DNA, 412 bp, Homo sapiens
agagagcgcactatttctaccccatcagagaacatgaagggatgcagagaagaatatgttgagttgactacctacctcacagaggacctctgcatgacatttagttgaagggaactgccttctctttttccaggaagattaaatctttatcctctctgccattcagtttaatacctatgtgcaaggcatcagtagagaccagatagatagatagatagatagatagatagatagatagatagatagatagacagacagatagataggcagagatgtttgtgtgtgtgtttgtgtgtgtgttgtgtgtttgtatctctaagtacatgaagaattggcatacatcccagaacacaacagactgaaactcctgattaaagataacaggtaaatggaatggacatccaataaaaac

SEQ ID NO: 1420 - DNA, 407 bp, Homo sapiens
ctgagttgaaataattctagctcatagttaatctataaagccttatccagagaaattggagattatctttaagcattttgaaatattaagcatagcctgctggccccaaatgacattttttttaatatttacaaattattaataaaactaaaaatttccatcccttccctggaaccccaagcaaccaccgattatttatttatttattatttatttatttatttatttatttatttatttatttatttattcattatagagatggagtctcactatgctgcccaggccggtcttgaagtcctggccccaagtgatccctccgcctcagcctcccaaaatgctgaggccacaggcacggatgcagagtttgcagatgggcagctaccattttcgagtatgcagtaact

SEQ ID NO: 1421 - DNA, 404 bp, Homo sapiens
ccttatccagagaaattggagattatctttaagcattttgaaatattaagcatagcctgctggccccaaatgacattttttttaatatttacaaattattaataaaactaaaaatttccatcccttccctggaaccccaagcaaccaccgattatttattatttatttatttatttatttatttatttatttatttatttattcattatagagatggagtctcactatgctgcccaggccggtcttgaagtcctggccccaagtgatccctccgcctcagcctcccaaaatgctgaggccacaggcacggatgcagagtttgcagatgggcagctaccattttcgagtatgcagtaactgagttttgtgagaagagcaaagtggaaagggagaatgacttaatt

SEQ ID NO: 1422 - DNA, 404 bp, Homo sapiens
gctgggcatggtggaggctgtgcttgtagtcccagctacttgggaggctgaggcagaagaattgcttgaatccaggaggcagaggttgtagtgaggtgagatcacgccactgcactccagtctggtgacagagtgagactgtctcaaaaaaaaaaaaaaaaacatatatgtgtgtgtgtgtgtgtgtgtgtgtgtgtgtgtgtgtgtgtgtgaaattatgacagaatttacctgtaaggtgttagtcatggaatactatgcagccataaaaaagaatgaaatcatgtcctttgtagcaacatggacgcagctggaggccattaccctcagtaaattgaggcagaaaaagaaaaccagataccacatgttctcacttacaagtgagagctgaactgagtatgcat

SEQ ID NO: 1423 - DNA, 409 bp, Homo sapiens
ccctgtctctactaaaaatacaaaaattagctggacatggtggtgtgcgcctgtagtcccagactcaggaggctgaggcaggagaatcagttgaacccaggaggcagaggttgcagtgaagccgagattactgttgattactgttacactccaacctgggtgagagagagactctgtctcaaaaaaaaaaaaaaaaaaaaaaaaaaaaagamcaaaacaaaaaaaagcctaaattatacaacaggatccatgggagaacatcttgatagctttttagcaggaacatcacattccaaatgcttgctagctattttctgagtatcagttatatttaccatgatcctgaggagcagaccctttattgtgtcccagttcagtttgcatcgtcttcatacagcataaggcaaca

SEQ ID NO: 1424 - DNA, 471 bp, Homo sapiens
tagaaggagtaggacagtaaatgtaaatgtctgtcctaatggattgttttatacattagagaacaattttttaagtgatcgagtaaacaaagtccccctcctacctccatggtgattgtttctcatagatgaaaacagttttctcatcctgacgacgacaacaacttcttcttcttcttcttcctcctcttcttcttcttctctttttctctttctttcctctttatttttcttctttctttcctcctcctcctcctcttcttcttctgcttcttcttctgctgcttcttcttcttctccttcttcatcatcattatctcatcatcattatcatttcagtgaccagttagtgagcaccttcatgtccaagcactgtctggggtcttcacagatgttatcctaatcttcacaccagtttaatacaagtgtgttaatatatttgatatgagtgctaggatatagtatttggag

SEQ ID NO: 1425 - DNA, 401 bp, Homo sapiens
ataataagatcctgtctctacataaaatttaaaaagttagttgggcatggtggcatgtgcctatagtaccagctactcaggaggctgaggcaggaggatctcttgagccaaagaggtcaaggctgtagtgaactatgattgtgccattgtactccagcctgggtgacagagcaatactctgtctcaaaaaaaaaaaaaaaaaaaaaaaaaggacttcaaatagcttacctatgaagaagctgcttggtaataccttaaatttcccttctatgcttttacacagaaccctaaccttgcagttgaggacttgagtcatctcacaattcttttgggtaaaaaaaatgtaaactactgtgacccaactttctttacagctgggaaggcctctatttgattgaaaa

SEQ ID NO: 1426 - DNA, 426 bp, Homo sapiens
ttttttccaatgtattccagaacccccatggatatcaaaattaaatgctsaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagasggagtctygctctgtcacccaggctggagtgcattggtgcaatctcagctcactgcaacctccacctcccaggttcaagcaattctacctgcctcagcccccaagtagctgggattgcaggcacaggccaccacacccacctaatttttgtgttcatagtagagacggggtttcgccgtcttggccaggctggtc

SEQ ID NO: 1427 - DNA, 404 bp, Homo sapiens
agagaggctccttccactctcagagcttccaacttaaccatctgtgaagagtaggtccttcaaaaccaactgtagcggcaaagttctgagrtgatatttccagactcagcagataggaacaggcatgctaggtgagatatggcagggaatattagtcagggttctccagagggacagaaccaatttgtgtgtgtgcgtgtgtgtgtgtgtgtgtgtgtgtgtgtgtgtgtgtgtgtgtgtgacagagacagacagaaagagagtgctttagtttaaggaattggctcacaattatggagactggcaaatctaaaatcttcaggctgggttggcagtctagagactcaggaaaagctgatgttgcagtttaagttcataagatttctgttgtcagaattctctct

SEQ ID NO: 1428 - DNA, 425 bp, Homo sapiens
  misc_feature (1)...(425): n = A,T,C or G
nngcagaagatagggtcattgtagagtggaaaaacatatctgaaacatggttgttaagtcataagctaatatttggaaagacagactccacttacttttttccaatagatatatatttactaaaatcttgggaaagctaagcttatgatcaggtgtaaccaggccatatcccttgggtcccaaagtcaataagcagggagagcttggtgtttaagtccttaggaatgggtcatgccactcagaaaagagaagagatgtttcgatctgtggattgttatcatctgcaacccaggaggctctttgattcttcatatcacgttatttttacctgaggattgtagataccctacagtcttaaagcctctggccaatctgccttggaaccacaggatacattaggcaaggtctggggctggctttgacaa

SEQ ID NO: 1429 - DNA, 407 bp, Homo sapiens
tgagatctggttgtttaaaagtgtgtagcacctccccaaccgatctcttccccttttgccttccaccatgattatgagcttcctgaggccctcactagaaatagatgctggagccgtggtggtacagcatgcaggactgtgaatcaattaaacctcttttatttcttaaattacccagcctcaggtatttcttttctttcttttttttttttttttttttttttgagatggactgtcactctgtcactcaggctggagtggagtggctcactgcaaccttcgcctcccgggttcaagcaattcttctgcctctgcctcctgagtagctgggactacaggtgcgtgtgcccacgcccagctaatttttgtatttttggtagagacagggtttcaccatattagccagg

SEQ ID NO: 1430 - DNA, 416 bp, Homo sapiens
gctggagatataaatttagaagacattggaatataggtttaattaaagccagttggccagatgagatcctccatgtaaagattatagatagagaagataagagggatcaaaaccaagccttggggaattccagtattaagagttgccagagaaagaaaccaacaaagacagaaaaagcaatcagtacggtgggaagaaacgtcataaaggcatgaaatgtcataaaggcatttcaggctagagaaagtgtttaattaaagagaagaaagaagaacttccattgcatttggcaatggaggtcacatttgtgatctggacaggatagttgcagagagtaatgagtttaagttgtacatcaaagtaaaagacacacactctggccaaaggaacagccacagaaggctggcatatgatgt

SEQ ID NO: 1431 - DNA, 403 bp, Homo sapiens
tgattttaaaggcccttgaaaacaaaataattatcttattaaaatttagttacatgttgtgtttaaaatgctaaagttttggccagcygcagtggctcacgcctgtaatcccagtactttgcccgagatgggcagatcatgaggtcaggagttcaagaccagcctgaccaacatggtgaaaccctgtytytactaaaaatmcmacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctraaatttatcggagaaaacaattgg

SEQ ID NO: 1432 - DNA, 401 bp, Homo sapiens
tggtgaaaccctgtytytactaaaaatmcmacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctraaatttatcggagaaaacaattgggatctatttttagtctcaaatgtaggcatatacaaaaataatacatagtagttttctaagtactattagacatttgtttcccattttgccatttgctttcagtttacctgacatgaagataaaaatgatagctatttctcacttggcatttgaaagacaagagcaataaga

SEQ ID NO: 1433 - DNA, 402 bp, Homo sapiens
tagagaaatattagtaggttagttagtattcctaataaagaactgctaataccttatagagacataagccatgtttctcgtctttcgtttctgaaatgaaattttggccagggaaacattttgcatccctttttgatgtctacaaatgtggcatttgtcagatgtgagatagttaagtgtgtgtgtgtgtgtgtgtgtgtgtatatatatactttatatatgtatatatacatatcctatgtgtgtgggtatatatatatatatatatatatatatatatatatatgaatgatgcatggagagatatctcttcccwtgcatccaaaatattcacaacttttcactaatatctgaataacatttgaaaaattgacaactcttctggctaaagatcagcataca

SEQ ID NO: 1434 - DNA, 401 bp, Homo sapiens
tcgtttctgaaatgaaattttggccagggaaacattttgcatccctttttgatgtctacaaatgtggcatttgtcagatgtgagatagttaagtgtgtgtgtgtgtgtgtgtgtgtgtatatatatactttatatatgtatatatacatatcctatgtgtgtgggtatatatatatatatatatatatatatatatatatatgaatgatgcatggagagatatctcttcccwtgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataact

SEQ ID NO: 1435 - DNA, 402 bp, Homo sapiens
ggaaacattttgcatccctttttgatgtctacaaatgtggcatttgtcagatgtgagatagttaagtgtgtgtgtgtgtgtgtgtgtgtgtatatatatactttatatatgtatatatacatatcctatgtgtgtgggtatatatatatatatatatatatatatatatatatatgaatgatgcatggagagatatctcttcccwtgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataactccgactaatagaactcattgcttttcca

SEQ ID NO: 1436 - DNA, 401 bp, Homo sapiens
cataggcatggacaaggacttcatgtctaaaacaccaaaagcaatggcaacaaaagccaaaattgacaaatgcgatctaattaaaytaaagagsttmtgcacagcmaaagaaactaccatcagagtaaacaggcagcctacagaatgggagaaaatttttgcaatctattcatctgtcaaagggctaatatccagaatmtaacagtgaactcaaacaaatttacaagaaaaaaacaaacaaccccatcaaaaagtgggtgaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggca

SEQ ID NO: 1437 - DNA, 420 bp, Homo sapiens
caagcattcatagcatagtatatcatgtagcagggtttaaaataagcatagaagagggtttcgccaaaagattatttaagaaaatctactaaaagagggttcttctgaaaaataaaatgtatttgcttttatcaaatgagcaaacttcatccacttggagatcacccacatgtgaatttctttctttctttctctctttcccttccttccttccttccttccttccttccttccttccttccttccttccttccttccttccttcttactttctttctctgatggtaagttacattagaggacaggaaggctcagtgatcagttttgatgggatggctgcacagaggcacatggagaagaagcaaggaagccaccttcagcttctgggtctctttgttatacaggaaaggaagtcaactg

SEQ ID NO: 1438 - DNA, 408 bp, Homo sapiens
accagcctggccaacatggtgaaaccccgtctctactaaaaatataaaaattagccgggcgtggtggcacatgtctgtaatcccagctattttggaggctgaggcaggagaaccacttgaacctgggaggcagaggttgcagtaagccaagatcgagccactgaaaccccagcctgggtaagagagtgagaccctgtctcaaaaaaaaaaaaaaaaaaaaaaaaaaaaaaatacttggtgcacttatgaaagcctgcagagcccagaaattctgatttaattgatctaagaaaagggagaggtaaaagctcccaggaaagtctagtgcccagccaaaggccatgggagtgatgagtgaccctgcccacacctaacggagcgtcccctgctctgctagtcagtcaacag

SEQ ID NO: 1439 - DNA, 408 bp, Homo sapiens
tgataggaggttctcataacagtccaaatgagaggaccaaaaggcctggagtcacgtcattgcagtaaaatggaagaaaaaacaagagtataaatgaagtgtcaaagatgttaagaaacaggatcttttaaaaaattatttttaattattatgggtacataataagtgtatatatacatggggtacatgtgaaattttgaaattttgatacatacaatgtataataatcttatcggggcaattggggtgtccatcacctcaggcatttatcatgtcttrtattagaaacagtccaattctcctcttttagctatttgaaaatatacaataaattattgttgagtatcatcactctgttgtgctatcaaatactagatcttattctttctatctaactatgcttttgca

SEQ ID NO: 1440 - DNA, 401 bp, Homo sapiens
ctcctcccaaaatgttatagacgtgagctaccacacccagccatgagtgtacattataaataaataccaataatgtactttcacatatgaaaaggctataaaagtatgcaaatatattatggcaacatctgttaagggataaagtgacacactgttgctcataactcgaaagaatatatatatatatatatatatatatatttttttttttttttcttttgaaacggtgtctcactctgtcaccaggctggagtgcagtggtgcgatctcagatcactgcaacctccgcctcctgggttcaagtgattctcctgcctcagcctcctgagtagctgggactacaggcatgagccaacatgcccagctaattttcatatttttagtagagatagggtttcacc

SEQ ID NO: 1441 - DNA, 407 bp, Homo sapiens
caccctgtcagagccctcaaagtcagacaaagaaggatgaaacatgttttggtccttaataaagaactgctgattgactgtttgaaaaacaaatgccgcacacctgtaatcccagtgctttgggaggccaaggcaggaggattgcttgagcctaggagtttgagaccagcctgggcaatatgatgaaacctaatctctacaaaaaaaaaaaaaaaaaaaaaaaaaaaagagccgggcatgaacctgtagtttcagctacttgggagactgaggtgggaggatcgcttgaaccctagaggcagagttacattgagctgagattatgccattgcactctaccctagggtgcaagattctgtctccaaaaaatgaaaaacagctgtatggtttggagagccagtggctga

SEQ ID NO: 1442 - DNA, 404 bp, Homo sapiens
gagtagttattgctgaatgtgtttggggtttcagtatgtggtgaaaaattctggatacagatgctcacatgtcattgtgggtgtctttcatgcaactgaattaggttttttttttgtttttgtttttgtttttttttttcagataaaccatgaatcacattttatttattttgtcctttcatttttttttttttttttttttttgagacagagtcttgctctgttgccaggctggagtgcatggtatgatctcggctcactgcaacctccacctcctgggttcatgctattctcctgcctcagcctcccgagtagctgggattacaggtgcccaccatgatgctcagctaattttttgtatttttagtagagacggggtttcaccgtgttagccaggttggtct

SEQ ID NO: 1443 - DNA, 417 bp, Homo sapiens
tcctgacctcgtgatccacccacctcggcctcccaaagtgctgggattacaggcatgagcctcaacttttattttacgttcagatggcacatgtgcaggtttgttacatgggtaaattgcatgttactggggtttggtgtacaaattattttgttacccaggtggtgagcatagcatagtacccaataggtagtttttccctttttttttttttttttttttttttttgagacagaatctcgctctgtcgctcaggctggggtgcagtggtgcratctcagctcactgcaacctccgctcctgagttcaagcgattccccctgcctcagcctcctgagtagttgggatgacaggcacctgccaccaggcccccataatttttgtatttttagtagagatggggtttcaccatgttgg

SEQ ID NO: 1444 - DNA, 401 bp, Homo sapiens
agtgtttaactcatcaatttcagatacacagtaaaagaatgtatatgagaattggtcaaggacattctgaggctttaagcttcaagtcaagaaaaacaactgcctttctgaaaacttacaccgctcacagagtctggtgggctatgaatttgatggtacaacttctaacttgacagtgtggagatcaagggtataggaawggtaaaaagctttgaaaagtttgagagtggagtttgcacagctggacacagggcaccacaaacacaggtggtgcatttgtgcctttggtggacaaagtatcacccacaatgcacaggcgcttccctggctggacaataggtctctctctccatcccctctctctctgtttcaagagaagacattttacgtaggaccttcca

SEQ ID NO: 1445 - DNA, 404 bp, Homo sapiens
ttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttmcttmcttccttccttccttccttccttmtttcyttccacagaatctcgctctgtcacccaggctagagtgcagcggtataatcaaggctcacagcagcctsggccttccaggctcawgtgatcctcccagctcagcctcccgagtagctgggaccacaggcacatatcagcacgcttggctaattcttttttgccttttgtttgtttgtttgtttgtagagacaaag

SEQ ID NO: 1446 - DNA, 402 bp, Homo sapiens
ccagcctggccaacgtggtaaagccctgtctytgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtytccacaaaaaaaaaaaaaaaaaaaaaaagagaaaagaaagaaaagaaaagatgaacatgtaacttacacaaaacacttgttgccatttaccatggggatataatgaactaacattcagaagtcacacatatgctgaagaagcatcaggatctacttcaaaagttaaaaacattaaaaaaaaacacagaaaaaaagagtgcatct

SEQ ID NO: 1447 - DNA, 405 bp, Homo sapiens
tgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtytccaaaaaaaaaaaaaaaaaaaaaaagagaaaagaaagaaaagaaaagatgaacatgtaacttacacaaaacacttgttgccatttaccatggggatataatgaactaacattcagaagtcacacatatgctgaagaagcatcaggatctacttcaaaagttaaaaacattaaaaaaaaacacagaaaaaaagagtgcatcttaaaatgacttaacacacacaactgcagaaggtggag

SEQ ID NO: 1448 - DNA, 402 bp, Homo sapiens
ccttgatgcaaatcaaaagactagatgtagctaattagacatgggaaaagggtggttctcctgaaaatctggggcctcaggcattttctggaatgtgtacagtcagaacgtgcaagttagtcagcaaagagaaaacaagcagccacacctctcccaaataccgaatagtcatccttcttttgtggttcagaggtgtttgtttgtcttakaatgctgcaacttaaaaccaattgattttaaataaaaatggtaacattataaagtgtgaaagtgtggggttaggaatcatttcccaccctgtgaaaatggctctatggtcacccgggtgtgtgtgtgtgtgtgtgtgtgtgtgtgtgtgtttgtgtgtttaacctgtgagataagaatggtcaaccagttgac

SEQ ID NO: 1449 - DNA, 401 bp, Homo sapiens
ttttctctatttcatggataatccatgcagtgtttgctcaacctgtttacactgagatgtgttgaggaactgtcccacggcaagaccacaaggtggggcagtaatgagtaattggaagaaaactgcggtaccttctaaagctcaaatgtggctttctagaacmcgatgaagtggagccctacattcattatttgaccttggttgttttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagccaccatgcccagctaattttttttttttttttttttttt

SEQ ID NO: 1450 - DNA, 401 bp, Homo sapiens
ctctatttcatggataatccatgcagtgtttgctcaacctgtttacactgagatgtgttgaggaactgtcccacggcaagaccacaaggtggggcagtaatgagtaattggaagaaaactgcggtaccttctaaagctcaaatgtggctttctagaacmcgatgaagtggagccctacattcattatttgaccttggttgttttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagccaccatgcccagctaattttttttttttttttttttttttttt

SEQ ID NO: 1451 - DNA, 405 bp, Homo sapiens
tgttttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagccaccatgcccagctaatttttttttttttttttttttttttttttaggagagacgggatttcaccatgttggccaggatggtctgaaactccggacctcaagtgatccacctgcctcggcctcccaaagtgctgggattacaggcatgagccaccatgcctagccctgtgactttttctcaagggcttcaaacagtccctctgcaagttaacctaggcatactcacagagcaagaaggcattcat

SEQ ID NO: 1452 - DNA, 405 bp, Homo sapiens
cttctccttttcatacaggttattgtttataagagcaatgtgatgaaagcttcctctgctaagactgcaactccagcgttaccttttctttacctcaccttgatcctcggtgtgaaacttcactcattactgatgcattgcaattaacagatctcctctttcaagacacattagggtatgttctgactatcagctccaaaaaaataaaataaaataaaataaaataaaacacattaggaaatttaaatgaattagtgtaatcagctgagatagtacttgaaagggaccgtgtaggcttgtggtggaataggtactttcagacagaagtctctagaatattcctgaggaagtattttctcctgcccttcaatgaatagagtggtaaggtttgtgaaaagcaggcct

SEQ ID NO: 1453 - DNA, 405 bp, Homo sapiens
ctaagtgatttacaaatgattattcttctgaccctcatcacaattctatgagagcagtctattattttcaccaatttatagaaaaggaaactgaagcatagagaattgaatacattttctttgatgtcatagcaagtaagaaaaaaggctaggattctaatccagggagtctggctccacaacaggtgcaattaaccaccagaccgtgaggcctctctgtcatatgcaagctcgtctgttttgctcagaagactgtgttttactcactcactcccaacttcttatggtaaaaattgctttttaatgatttaaataatacatgcccatgtaaaagttaaatcaatgactaaagcattctgaagaaaggaaaggttacctggaatcccatgaccctgaaataaccat

SEQ ID NO: 1454 - DNA, 405 bp, Homo sapiens
catcagacttcagaggaattcagacttaaaattcatgtgcctttgaatggggaccacatacatgtcacatcacactaacactaatgtttcattgattcattctatcccttcccaggaatcaaattctgattaagagaaagaccctaagtggctgaaggaacaaaaagagttattgcaaaaaaaaaaaaaaaaaaaaaaaaaaaaagctgatgcagttaggaaagggaagcctgagctattaagaaaaacacattgcttcttacatagtagtgctaaaggccaagcctgcatatccctgcaatctataaagtctgttttctctgacagtgtcagagttggaaagatcaataggtgtcactcacaccattcatcatctcagaaatgagaagatttaggaaaggagat

SEQ ID NO: 1455 - DNA, 409 bp, Homo sapiens
tactccaactactgatatatcaaagtgtctgttcttgtatcattatcaaaattttaatatttaattatctgatgagtgaaaaatgacatctgatagtcctgtcagttagtattgcttttaatgtgactaatttttagcttttattcatgtttaaatgaataaaatgtactccctttactacttttttttttttttttttttttttttttgagacagggtctcaccctgttgcccaggctagagtgcagtggcgtgatcatggcccactgctgccttgacctccagggctcaagcaatctgcccacatctgcctcctgcctgtgttgctcagactggtcttgaactcctgagctcawgcagtctacctgccttagcttcgtaaagtgctggaattacaggcgagagccaa

SEQ ID NO: 1456 - DNA, 414 bp, Homo sapiens
ttaacataatgacatccagttccattcatgttgatgcatataacagatttcattctttttatggctgaatagtaatccattgtatgtatatacacatataacgtctgtatatataatgtgtatataaaatgtatatccataatatatgtatatatacacatatatgtaatatatatwgtgtgtgtgtgtgtgtgtgtgtgtatatatatatatatatatatatatatatatatatatctcacttttttttttgagacagagtcttgctgtgttgcccaggctggagtgcagtggtgcaatctcagctaactgcaacctccacctctcggttcaagggattctcatgcctcagtctcccaaaaagctgggactacagtcatgtgccaccatatccggctaatttttgcatttttt

SEQ ID NO: 1457 - DNA, 406 bp, Homo sapiens
tgtggagcttccccagcccgctcagkctgcccccagtcttcccatttttagaaaaattaaaactatggtttgttaaagcttctattctgatggtctctgttacttgtagctgaacgcaatgaattgtgagatacgatttaccacaatttttttctttctttctttcttttttcttcttcttcattttttttttttttttwttttttaaagggttgtgccatgtcacccaggctggagtgcaattgtgcgatcatgactgactgtggtgtcaacctcccaggctcaagcaatcctcccacctcagtctcctaagtagctgtgactataggcatgtgccaccatgccaggctaatttttgtattttttgtagagatggggtcttgctgtgttgcacaggctggtctca

SEQ ID NO: 1458 - DNA, 449 bp, Homo sapiens
tgcatctgtattgccatcaccctagttctggccatcctcactgaccacctgactttctgcctaaatggtctcctactttctggtcttgtatactttcaaccctttctctgcaatcagagtgatattgcttccartgttgtacagacaattcttacaaggtcctgcagcttttctttcagtctttctttcttttttttttttttwttttgaaatggagtctcactctgtcacccaggttggagtgcagtgggcgcgatctcagctcactgcaacctctgcctcccaggtttaaacgattttcgttcctcagccttccaataactggggttacaggtgcatgccaccatgcccagccaatttttgtatttttagtagaaagagggtttcaccatgttggccaaactggtctcaaactcctgacttcaagtgatctgtccaccttggcctcc

SEQ ID NO: 1459 - DNA, 402 bp, Homo sapiens
accagcctgggcaagatggtgaaacgccgtctctactaaaaatataaaaattagccaggcacagtggcaggtgcctgtaatcgcagctacttgggaagctgaggcagagaattgcttgaacctggaaggcagaaaagttgcagtgagccgagatcatgccactgcactccagcctgggcgacagagcgacactctgtctyaaaaaaaaaaaaaaaaaaaagaaagaaaaaagaaatgagcaagcactgaacacctactgtgtgcaaggcacttgatagccttcctgttatttcttcctcactacaatcccatgaagtagttcttatccccattttacaagatacaaaaattgactctcaaaaagcttaagaaatttgcttctagttgcacagtcttatagat

SEQ ID NO: 1460 - DNA, 402 bp, Homo sapiens
ctggttttcagactagaatttataccattggctctcctggttctcaggccttcagatttagactgaaactacactatcagcattcctgagtctccaaattgctgactgcagatcttatgactttccagtcattccattccttgtcataactctctttctctttctttctctctctctcctctctctctctctctctctctctacatatatatatatatatatatatatayatacatatatatatatatatatatatgaacagatacatcctattggttctgtttctctggagaaccctgactaatatacagttatgtgtcacttaacaataggatataytccaaaaatgtgtcattaggcaatttcatgatttgtgaatatcatagaatattcttacacaaa

SEQ ID NO: 1461 - DNA, 402 bp, Homo sapiens
tctcctggttctcaggccttcagatttagactgaaactacactatcagcattcctgagtctccaaattgctgactgcagatcttatgactttccagtcattccattccttgtcataactctctttctctttctttctctctctctcctctctctctctctctctctctctacatatatatatatatatatatatatayatacatatatatatatatatatatatgaacagatacatcctattggttctgtttctctggagaaccctgactaatatacagttatgtgtcacttaacaataggatataytccaaaaatgtgtcattaggcaatttcatgatttgtgaatatcatagaatattcttacacaaacctggatggtttgctgcacacctaacctgatg

SEQ ID NO: 1462 - DNA, 403 bp, Homo sapiens
tgaatgctaatggtattcttctagtctagtgcattcaattaaaatataacgtgtgttacatatgaagttaaaaatgtttagtaaccaaattaaaaaggtaaagagaaataagtgaagttaattttaataatatattatctttaacctcttttaataatatactctctttaactctttaatatatttaataatatattctcttttatatacatagaacattgtcatttcaacatgtaatcaatataaaaaatatcaattagatattttacattctttttttcacattaagtctttgaaatttagcacgtattttacacttacagtacatcttaatttggactagatgcatttcaggttcccaatagccatatgtgtctattggcgttcgtatcatatttatcat

SEQ ID NO: 1463 - DNA, 407 bp, Homo sapiens
tgtgtttttattattttttctgataataaagattaatgcagatacatgaaaaaaacaaaacataaaaagtaggaacagaaagtcaaatactgcatcttctcacttataaataggagctaaataatgtgtacagacaggcataacagaacggaacaatagacactggagacttggaagggtgggtgagtgagcagggttgagggatgaaaaattaccttagaggtacagtgtacattatgtggatgatgatttcactaaaaccccagacctcatcactatgcaatatatccacataacagaactgcacttatacccataaacttatatttaagaaaagaaatagaaaaaagataatttttttaaagtagaaagagggaaaaaagtaaagcatcatcccaatttctttc

SEQ ID NO: 1464 - DNA, 404 bp, Homo sapiens
gaaccactaaagtctagagcacataggctagaggctagaataagtgagaaatagctaatcctaggaagataaattggggcttaattgtaaaaacctttgcatgctatactaagaagctttgagttcattctcttggcaactatgagccattacatgtttcaaaagatagatctgatggaaaaacagaagtatagagggtaggtaatattctaatgtgtaaacttctactgtgagtccaaaagaatatggtatctatctctgaaccatgttcaatattttgcttagactgttcgaactatgtaagaataagaaatactaaagtgttttttctctgatataatatttaaataccttttagctatcaattccttctaatttccctttaataagacatttactacaaa

SEQ ID NO: 1465 - DNA, 401 bp, Homo sapiens
tttttgacatgtattatttgatgaaaccctatgagattaggtctttacttccgaaagaagaaaaccaaattcaagggcaattaaaaacttgtcaaatgtctcaattttagtaagaaaaaaaaccgacattggcctagatcttaatctgtgcccagtcctcttcccatccctctttttttttttttttttttttttttggkgggctgctctcaaatttttgggctcaaatgaacctcctaccttggcctcccaacgtgctgagattacaggcatgagccaccgtgcctggccagctaaggttaatttagtattgaaraaatatttttgttatgaatttagtgtagccaagtgtgcagtgtttaraccatctacagtaatgcacattaatggcctaggccttc

SEQ ID NO: 1466 - DNA, 402 bp, Homo sapiens
ctgaggaactcaatcaacaggattgcaacatgctttttttaaacctcttgaaagatcacatcactacagaataaggaaacctatttatttatttaatttgagacagtctctctctgtcacccaagctggagtgcagtggaatgatctcagctcactgcggcctccaccccagttcaagcaatttcatgctcagcctctgaatgtaagctgggactacaggggcacaccaccacgcccagctaatttttttgtatttttagcagagacaggttttcaccatggtggccacgatggtctggaactcttgacttcaagtgatctacccacttggtctcctgagggaaatctatttatgactaatgctgttctttttactaattgtttcattggctgtcagccctt

SEQ ID NO: 1467 - DNA, 401 bp, Homo sapiens
ggaactcaatcaacaggattgcaacatgctttttttaaacctcttgaaagatcacatcactacagaataaggaaacctatttatttatttaatttgagacagtctctctctgtcacccaagctggagtgcagtggaatgatctcagctcactgcggcctccaccccagttcaagcaatttcatgctcagcctctgaatgtaagctgggactacaggggcacaccaccacgcccagctaatttttttgtatttttagcagagacaggttttcaccatggtggccacgatggtctggaactcttgacttcaagtgatctacccacttggtctcctgagggaaatctatttatgactaatgctgttctttttactaattgtttcattggctgtcagcccttaga

SEQ ID NO: 1468 - DNA, 405 bp, Homo sapiens
ttctttctgaaggggttctgtcactaacaggttgcattacttgtacaaccattatatctgaatcttcccagaccgtggtttttttttgtttgtttgttttgttttttattaaatactgtcattaaaccagaactcatggatatctatgtcatttccagctataaaattctagaaacttggggattttacctttttgtttcttattttattttcttttttatcaaaagccttatcacaggtaaaatggtaatctaagcaagaataagctctgtcatgatttatgaagcatggaaattcagctgtggccaggcacagtggctcacatctgtaatcccggcactttgggaggccgaggtgggtggatcacttgaggccaggagttcgagaccagcctggcccacatgg

SEQ ID NO: 1469 - DNA, 404 bp, Homo sapiens
ctttaacatttctctgaataacgtgaaccttccttatttccttaaaatataaacttatatatgttcttcctaggagattttcaacttttctgttctccacttattactctattcactctgttctctatctgagctgtcactaattagtatctacttaaataaatatttgagcaatttaacattacagtttttttttttttttttcagcaagaagtgtgttcattatccattaaaagcctgggagagggactactaatgttacaccatcaatatctatttttagccacttcggttttggaagtgtctcttcttttggaagtgggagaccaagtggaggggaagaacatgaacaagggattgaagccattgagaaagtcatttattcattcgatagatatcttctg

SEQ ID NO: 1470 - DNA, 403 bp, Homo sapiens
ttgaaataaaactgactatggtaagaagagtttttctgggagttgggaaactgattccattagaaggcagatggtgatagtctcacagcacactctctcccatgcggtctctattctacaggcatgcagatatttccaaaagcatcccttccctccagggtcctgaagaccctacctctggttctgccttggactgctcttctcagtgatattccctttttttttttttttttggacggagtctcactctgccgccaggctggagggcagtggcaccatcttggctcactgcaacctccgcctcccaggttcaagtgattctcctgcctcagcctcccaagtagctgggactacaggcacgtgccaccacgcctagctaatttttgtgtgtgtgtgtgttttt

SEQ ID NO: 1471 - DNA, 401 bp, Homo sapiens
gactatggtaagaagagtttttctgggagttgggaaactgattccattagaaggcagatggtgatagtctcacagcacactctctcccatgcggtctctattctacaggcatgcagatatttccaaaagcatcccttccctccagggtcctgaagaccctacctctggttctgccttggactgctctcagtgatattccctttttttttttttttttggacggagtctcactctgccgccaggctggagggcagtggcaccatcttggctcactgcaacctccgcctcccaggttcaagtgattctcctgcctcagcctcccaagtagctgggactacaggcacgtgccaccacgcctagctaatttttgtgtgtgtgtgtgttttttttagtagaggtgg

SEQ ID NO: 1472 - DNA, 403 bp, Homo sapiens
actgctctcagtgatattccctttttttttttttttttggacggagtctcactctgccgccaggctggagggcagtggcaccatcttggctcactgcaacctccgcctcccaggttcaagtgattctcctgcctcagcctcccaagtagctgggactacaggcacgtgccaccacgcctagctaatttttgtgtgtgtgttttttttttttagtagaggtggggtttcaccatgttggccgggatggtctcgaactattaaccttgtgatctgcccacctcggcctcccaaagtgctgggattacaggcgtgagccactgtgcccggccgatattcctgtttttatggttgcaattgtatgctatggcaccggtactatgtgggaagaatgatgctaggtact

SEQ ID NO: 1473 - DNA, 408 bp, Homo sapiens
agaccatcctggccaacatggtgaaaccccarctctactaaaaatacaaaaattagctgggtgtggtggggcatgcctgtagtctcagctacttgggaggctgaggtaggagattcacttgaagccgggaggtggaggttgcagtgacctgagatcacgccactgcactccagcctggtgacagagagagactctgtctcaaaaaaaaaaaaaaaaaaaaaaaaagtgcctactcataccctcctcctatttattctgatttctgtgcatgtattctttttgtttgtttgtttttcagagacaaggtcttgctctgtcacctaggctggagtgcagtggcacagtggcatgaccatagctcactacagcctcaaactactcctgggctcaaaatgatccccctgcctc

SEQ ID NO: 1474 - DNA, 403 bp, Homo sapiens
cccatttctaaaaaataatatcttttaaaaaattaactgggcatgkcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaataaaattagaaaggataggtgtgtktgggagggagactggttaaycagggtgcatgggattatgtagggcttgtctttcatttgagttcttctctgtctttttaaaatgactgattatatatattaggtcccaatggcttcattatcactattattttaattcataggttaaattttataaacatgaaaaataattgacaagc

SEQ ID NO: 1475 - DNA, 405 bp, Homo sapiens
aggcctcaggaaacttacaatcatggcagaaggagaagcaaacacatccttcttcacatggcggctgcaaggagaagtgctgagcaaaaaggggaaaagccccttataaaaccatcagatcctgtgagaactcactcactatcgtgagaactcacttactatcatgagaacagcatgagggtaacagcccccatcgttcagttcaattacctccgaccaggtcccttccatgacacatggggattatggggactacaattcaagatgagatttgggtggggacacagccaaaccatatcagaaggtaaggcctattttagtaagttttgtttatgcaaactcatctcagtgttgactccctatctttataacatgggtcacttttttcttcctgatggtgtgggg

SEQ ID NO: 1476 - DNA, 410 bp, Homo sapiens
catgcccaaataatttttatattcttagtagagatggagtctyaccatgttggcaacgctagtctcgaactcctgacctcaaacgatttacccacttcagcctcccaaagtgctgggatcacaggtatgagccaccgtgcctggcctatacttgtgtatactttgaattgtttcttttttcttttcctattttattttattttattttatattttattttattttattttttgygacagggtctggctctgtcacccaggctggagtacagtggtgcaatcatgactcactgcagcctcaagctcctgtgctcaggtgatcagcctcctaggtagctgggactacaggtgaccaccatcacacccagctaatttttgtattttttcatagagatgaggtttcaccatgtt

SEQ ID NO: 1477 - DNA, 408 bp, Homo sapiens
tgttccaattcatggagcaaccagacatacatgttcaaayaattatgaaaaacatacaacagatatttatcaacaaatacatcagtaaacaaacttacatgaccctgcttggccatcactgtttcttttcaacacacacacacacatttacaaatacatatatatgtgtgtgtgtgtgtctgtctgtcgatatatatgtgtatatatatatatatatatatatatatatatatatatataaataaaataaataggtaagagctgcttatagccctgaatccccacagaaaaccccgtctgtctttagtttcatgaaagcattgtactttttctcattatttttcagaccatcacagacacttctgatcagtgttccacttaagcttagccccaaatacacagaggaat

SEQ ID NO: 1478 - DNA, 404 bp, Homo sapiens
attcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagacta

SEQ ID NO: 1479 - DNA, 400 bp, Homo sapiens
ctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaawacaatataatcyatcttttttttttttttttttttttgacacagagtcgtgctcttgttgcccaggctggagtgcaatggcgcaatcttgactcaytacaacctccgcctcccaggctcaagcaattctcctgcctcagcctccaagtagctgggattacaggcgtgcgccaccgcacccagctaagttttgtgtttttagtagagacggggttt

SEQ ID NO: 1480 - DNA, 402 bp, Homo sapiens
tattaggggctraataccaacaacataagtcagaaaagggtttacattgacccctttggattctaaatattgtaataaatattattagttccgaaatatcatatctgtttgatttcccaaatgattgcagaaawgcttygatctttttagtcctatratattgtagagatatctcactaaygatgttttttttttttttktaagatrgagtctcgctgtgtcgctcaggctrgagtgcartgagccatgtttrtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtat

SEQ ID NO: 1481 - DNA, 401 bp, Homo sapiens
taggcaaacaagaaagaatgcatacagttttatcartttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtmattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaatt

SEQ ID NO: 1482 - DNA, 401 bp, Homo sapiens
gcaaacaagaaagaatgcatacagttttatcartttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtmattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaatttta

SEQ ID NO: 1483 - DNA, 401 bp, Homo sapiens
gttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaattttttttttttttttttttttttttttgaracagagtttctctctgtcacccaggcttsagtgcggcagtgcaatctcggctcactgcaaccaccacctcccaggttcaagcgattctcctgcctcaacctcctgagtagttgggattacaggggcacgccaccatgcttagctaatttttgtatttttagtaragacggggtttcaccatgttggtcaggctggtc

SEQ ID NO: 1484 - DNA, 416 bp, Homo sapiens
gcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaa

SEQ ID NO: 1485 - DNA, 402 bp, Homo sapiens
tgaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatatatttcattataattgttgcttctgcagaaaattgggatagaaatctcagatgagctgtagttacacggagatctacagcaatgcaatgtttagctagcatgcattttgtcatccaaggctagtaggtgaaatatttcctttacctgtcttgatgcacggtggagaaakgagacccgcttcgttttccctctaatctagagag

SEQ ID NO: 1486 - DNA, 401 bp, Homo sapiens
ctttctctgctaatagatctataaaatgtggaaagagatgttttacaatctctcatagcaatcctattttttgttttacataatttgatgcttttatatgaaacataaagtttcatggctattataaattttatgtagattttgcctttcatgaatataaaatgaccttcttttctatggaaaccttttttttttttttttwaccttatattaaattttgtttgaaatcaaaggggccatcctttctgtttttaaaatttcatttgtctggtaagcctttgcttattctttcaaaacatttctcattttaatgtgtctctttaagcttaaatagcgtatgtctagatttttaaaatctttttttaaatggggagttgaaataacttaaatgtattatcata

SEQ ID NO: 1487 - DNA, 400 bp, Homo sapiens
tcagaaaagggtgtatctgtttttgcattctgcttggtgggagaaagaggaccaatttttgaacatgaaaataagtagataagaatctgtgccctgggctcaccatttctactgggtgttgacagttgcctgaagcacaactttgtctctctgacccagtgttttgccactctcctccacctgaagaagatttttttttttctattgcttggctcttgggcaggttgaggagagaagagaggagatgaaggatgtgtaggttgctcctgctgtaaagatcygccctattttgcctggcccctgtcctatttctagtttctgctaccttcagacatgaggttactggtgcttctcctgtcttttgtagtttcgactctcttaagtgcatttgggctgtggt

SEQ ID NO: 1488 - DNA, 401 bp, Homo sapiens
  misc_feature (1)...(401): n = A,T,C or G
ngtaggtgaattaaaattctagagtaacaacatgaaaaggatgcagtaagggtccattgcttagtaaagtcatacactgtctcaatttaactgcattaatactggatacaacagtagctggaacaagttgtaaataattatctactacctagctttgaaagagagcacattttacattcttatggaaacttttttttttttaatgatgaaacaaccaattctgtagcatatagaaaatgcataatgtcctgcaaaaataactgtgtagtggaaaattatctctttcagatattcatcacttactgttcactgattttcatgctgagaggttcatgcttagactactcttcaaacaagtttatctgggttgaagttttttgcctcgctccctttggacggga

SEQ ID NO: 1489 - DNA, 403 bp, Homo sapiens
cttcctctccatctcctcactgcttacataggagctcagcttcctcttaaaatccctttcagagaaccctggaaattttcaggatgttttgctcaggaaaaaggctgctcatgttgtactaattctggcttctcatttccgtctcttagttctgcttctgtgggagctgccctccctgaaaatgtgtgtttctgtagtggggtacgatccactgacgttcctgaaggaagagcagttctttaggtgcctgacttggtgaggactttgtcattgatgccttaaagcatcaatgrtcatgatgagagccttacgtagtctttcatgaagtcagctccttcacctgtcaccatcccatttttccctccacaggtgtcaygtagggaggagagaaggaaattccttg

SEQ ID NO: 1490 - DNA, 402 bp, Homo sapiens
ataaaattttcattctcacaatgagaatagtctttcattctctatgaattctccaaataatttagtgattaagaaaacagatctattttcttaatatttcataarccttttggttacatactaaaacaatgtattaatattcttatacggtaatcatatttgagttggttcattagactttattttaacattatgagtaatttttttttttattagaaagtcttttgaattgtagggcataaggaatttttagttgtgactcctaggtctaacatttaaaaaaattcaaaacacactgtcttagcaatgttactagaattaatcaaacgctaaaattttgtaagcctgactccatagaccataaaatattggaaagatcacttgctatgaagtcaataaact

SEQ ID NO: 1491 - DNA, 400 bp, Homo sapiens
tgagcacctgaccgctatttatcaaacattgttctaggggatgtggggaattgtaagagaagctcaagacagtgttcttgtctgggctgatgaaaccttatcctaattcaggctacagtgaatactttatgtgcaytctgagtgttcctatcctttccttgttatatggcaggagtttttgatatagggtacatggacccacaggaggcccttggatagaacacaagtggtaaaattccatcttttaaataattaactactaactgaaatttagccatttcttcaattatatatgttggcacaaaccacagtagtattaagagtgtctctgaccttgtcagcagtagaaaacactgatatttttatataatatcacagttgttgcagatatcttgraaca

SEQ ID NO: 1492 - DNA, 403 bp, Homo sapiens
gaaatgtgtggaatgtaagaaaaacagtgttaagacagaagtttacagttataaatgcttacattaaaaaatgcaaataaataacctgaatgtatacatatgtaactaacctgcacgttgtgcacatgtatcctaaaacttaaggtataattaaaaaaaagaaaaataaataaatattaaaattcaaaaaaaaaaaaaaaaaagagaaaaaggaaaatagagagggaaaaagctaagatggctgactagatgcagccaggaaacatctatcccacaaagagaactcaaaatattgagtaaatcatcagacttcatacagatcttttgagagaaaacacttaaaatcaataaacacagagacactgaggttgaagagggaggaagctgggaagcctgcacagag

SEQ ID NO: 1493 - DNA, 404 bp, Homo sapiens
  misc_feature (1)...(404): n = A,T,C or G
nntttcaaaaatctaaaaatggaattaccatatgatccaacaakcccactaccaaatatttatccaaaggaaaagaaatcagtatgtcaaagacatacctgcacttggacgtttattgcagcactattcataacagcaaaggtatggggtcaacctaaatgtccatcattgaatggatggataaagaaaatttggtatgtacacacacacacacacacacacacacacacacacacacatacacagtggaatactatctagccacagaaaagaatgaaattatgtcatttgcagcaacatggatgaattaataaagtgaaaagacaaaaaaggaaagaaaaacctatcctaaaatttatatggaatcttataggatctgaataatcaaaataatcttgaaaagg

SEQ ID NO: 1494 - DNA, 401 bp, Homo sapiens
  misc_feature (1)...(401): n = A,T,C or G
ngctgccatgtaagacatgacttgactcctcctttggtttccggcatgattgtgaggccttctcagccatgtggaactatgaatccactaaacctctttttctttataaattacccagtcttgggtatgcctttattagcagcgtgaaaatggaataatacaggtggtaaatttcatgttatgtgcattttaccacaattaaaaataataaaaagatgatcatgggcttctagttcaattattccatttcttctccaaattataatcttaccaaaggaaaaaaaaacaaatgagatttaaactgccaagaacaagggcaaggtgagggtctttgggccttataattgatgaatatcttgccaaagtaacattacttagagtttcaaattgctgaacgatga

SEQ ID NO: 1495 - DNA, 402 bp, Homo sapiens
  misc_feature (1)...(402): n = A,T,C or G
ngagatacataattttttttcttagatttaataatgtggattataataccaatrggttatctaatattggaccaactttgcattctgaaagaaattccacttagttgtgttgtattgatttcacaatgtataagattctgtttgctaatgttttagttggtatttttacatcaatatccataaacatactgctctgtaggtttttttttgtatttttaaaaatttagatttaggtattagtgtagtacttgcttcttaaaaattgggaactttttattcatctttaatgttctgcagcactctataaaacattggaaatatcaaatctttgatgattcggtagaatttttttccaaagttatctgggcaaggtgctttttkgttgatgtttttcttaataac

SEQ ID NO: 1496 - DNA, 402 bp, Homo sapiens
  misc_feature (1)...(402): n = A,T,C or G
natggctccattttttcactgctccctatattcatgtcttttgccatcttactttgcagtgttcctccattctgacacagtacatggccacgtaacttgctttttcctaggaggaagtagaagtggcagtgtgctaatacaaacctaagcctcagaatgtcttatatatttgctttttgttgttggctttagtttttttttggctgtttcatttctgcacttcagcctgctgggaactgggaaatagaaggaatatagccaagccatcaagatcatccaagctgaggccagcatcaaggagctggaagcctataaatgcagatatatgagcgagctctgctaacatcagtagtgctcccaactgactactccagacgtcgttagaacttactgctgtgtact

SEQ ID NO: 1497 - DNA, 402 bp, Homo sapiens
tgctaagttcagactgttcagtcaattgattatactgagagagattatgcagtaaagttatttagctgackggtaaagagtctctttggggatggtgtgcccagcgcacaaggttaaggagttggaagatttcttctgtgaataaaatcaatgtttggggctcagtctatcgggaatgacttattactagtactaaaatttgtgtgtgtgagatttaataagtctttaatatggtcttcatttgttgcttcatttattcaaacatttattaattgcctctgtcttacacatagaaaaaaacctaatgctaaggctgttgtcactgcgctcaaggagaagaggaaaataacagtaatttatacctgctagtatgtgctaggaactattttaagtgtgttatgc

SEQ ID NO: 1498 - DNA, 401 bp, Homo sapiens
atgacatgggaaggagggcttgctcaataaacattgcctgttatagtgtgctggcattaccttaaaatccttaataagctgtaagttttggatgagagtcagaagtgttgggttggtgaagcattttgctacagattgcaggcttttctccggtgtcacaaggcattgaaaacgcttgttcggagacagcccagaagggaaaaaaaaaaaaaattctggaaagcctggcattttgtgctatgttgtgagtaagacatttatagttattgagccaaaatttccactgtaatagaaaaagcagttgcttttaaacttctggtccaatttagtaattatgggtgagttaaaatgtaggccatttgaattggatttggaggatcaagtaagattctgtcctacag

SEQ ID NO: 1499 - DNA, 401 bp, Homo sapiens
gcacaaattacaactcctacacagctctaccccctccacttttgagtttcaagacttttgccaaagttttctggtctttgttcacttctattattaacatctcttgtgtgaaggggaattttgaatgaatgggatgaaatcatctaaaccagcttcggtcctaaatatagtgtctggcatcaggtctgggaaaaaaaaaaattggtcaaagagatagcctgaggttatttttaggaagttggatgtttagggaaattratactatgaaagttctggcctctatctctgaagatattccattgagagatacatgcatgcattcaacatctcgtttttttccattcctgcccttygggtgttccgcgtcattcactatcttgtcattacagcattaagcagaa

SEQ ID NO: 1500 - DNA, 401 bp, Homo sapiens
gcagtgcttggctggagtaagctccatgtaaatgttagtccttgaatgaaagtagagctctggtagagatattccataaagacaaccttaaacatttttgaaccttttatgcctccaaaatatacacttccaaactcttctatcactgaccatattacttataccctaacaaggaagttattaagaatcataccagagtaacaggaataaatcatgccagtcaggaaaaggggtacattggttattctatttataacattacttgagtatttataacaacaagtaaacaaaacgttttttagaaaaagaagagattactgtgttgtacaaatattactagatgggtaatttctctcctttttttccaatgtattccagaacccccatggatatcaaaatta

SEQ ID NO: 1501 - DNA, 401 bp, Homo sapiens
atagcaccacccttatgcttactaatcccttcatctttaagacacctggataatgagctatctgcatggttggaaatagtctgggtttgttctaaattttacattagataacaggtcagcaacaaaataatgggagggggaaattagaaaacattaagtcttatttcatgtcatgtgatacagtatatatgtattttttttaataaaagaaagtgacatatattgtagttcaattggatatttacatttcatgtagaccataatggtagcggtaattatagaaatcttagcaactttcaaaggaaatttttcccagcaagatgactgacaaaatttttgaaagtaatagagagaaactgaggcataaaatttacctgaaagcagtcctgtttaaattggac

SEQ ID NO: 1502 - DNA, 401 bp, Homo sapiens
tccagacgaggtcagataaagtggattatatgggtaaacattgtggaaagtaagcttttcgaaatattgtaactggtgaaaagttgtccatcatagttaatgggctacctgagcaaatacctttcctgagctttttcttgaattcatagaaacttgggtctgaaagaaaacttacaagtcatcacttttttttttttttttgagacaaagtctcagtctgttgccaggctggagtgcagtggtgcgatctgggctcattgcaacctccgcctcctgggttcaagcgatttttctgcctcagccttctgagtacctgggactacaggtgcacgccaccatgcccagctaatttttttgtatttttagtagagatggggtttcaccacgttggccaggatggt

SEQ ID NO: 1503 - DNA, 401 bp, Homo sapiens
cacggtgaaacctgtctctactaaaaatacaaaaaattagccaggcatagtggcgggtgcctgtagtcccagctactcaggtggctgaggcaggagaatggcgtgaacccgggaggcagagcttgcagtgagctgagatcacgccactgcactccagcctaggcgacagagcgagacttggtctcaaaaaaaaaaaaaaaagaagtaattggatgaggtgatttatgtaattcctacaacctctcagtgctaacaaagcaacattcaatgacatttacaatgatcatggtggcaagttgggagagagaaagggcatttctgaagtaataataaaatgagtaaaataagatggtagtgccgtgtgttgatattgtgaactttacatttttactttctctcat

SEQ ID NO: 1504 - DNA, 401 bp, Homo sapiens
atcctaatttctgaaattattcctgaaaattcaagtccattgtttgtctcccaccctatcctttggttctgtcacctcagaactaacaccttgacaaagtgtttcttttttgtccttctaccctccccgcaaaagtttattttttaataaatcgtttctggcaccaacccaaaccacaattacttaaaaagaaaaaaaaaatagcccaggattccatttacttataaacttgctttctgaactttatttttaatttcagcatttttttttttttttttgagatggggtctcgctctgtcgccaggctggagtgcactggcgtgatctcggctcactgcaacctctgtctccctggttcaagcgattctcctgccttagcctcccaagtagctgggattaca

SEQ ID NO: 1505 - DNA, 401 bp, Homo sapiens
agtggaagagtttcaaggcaatcttccactcaggactccttatgccttgcatgcacacaaagcagcgttgctcaaaacataggaaacaactatgaggaataaaaaggaaaagcttgttccttaaagaacgagaaggaggccagcagtctttttcataccttcttgtttatagaaagcagatttttttttttttttttttttagtaaaagcatatttggagcaggaaagaaatatgacctagactgtgttgttttcttttattgtatctacaaatagtttagctgaagtgagcttttcagttattgattttaaatcataagtttaattcgtcatcaaggcaacaacaaatgtgatgtttggggcagatgcaaagttgaagtatgtctaaagaaatagcacgc

SEQ ID NO: 1506 - DNA, 401 bp, Homo sapiens
tgtttgatctttgtaaaactacatatgactctcaagttgcaagtgatactgtggttcagcttatcaaatactggaatttggcttctgtcactgactctgccactggctttgtggtcctgaacgcagccctgatgtcagatgtgttggtaatcttggggaactttaagcaagccagctttttttttttttttttttttttttaggactagatggaggtaagggaaagtgtgagacaataaaactggcaaccagaaacagaagaagaaaggaagagagaaaggaatctacggagtgtggaagttttaggagtaaatttctatataagttgcaaaattttagtaattctttagttcttatttcatttattcacttattttttttttcttttkagacagagcctc

SEQ ID NO: 1507 - DNA, 401 bp, Homo sapiens
gcattttctgtctgatttaattaagaccactacctgctgacaaggctttgagaaagaaacaaaaataaggaatgcacaaataaaatgtaatgcaggtcaggcatggtggctgatgcctaagtgggaggcttaggcaggtaatcacttgaggccagaagtttgagaccaggctgggcagcacaccaagaccatctctctacaaaaaaaaaaaaaaaaatacaaattagccatgtgtggtgatggatgtctgttgtccagctagtcaggaggctgaggtgggagaatcccttgaggccagttcaaggttacaatgagctatgatcatgccactgcactccagcctgaacaacagaatgagaccctgtctcattcaattctttaaaaatctaatgcaaaaacat

SEQ ID NO: 1508 - DNA, 402 bp, Homo sapiens
tcctttggatattagcattggaaagagtgttttttgccagccttgatggtgcacccctgcagtcccagatacttgggaggctgaggtgggaggatcacttgatcccaggggttcgaggctgcagtgagctgtgattgcaccactgcattccatcctgggcaacaaagtgagacactgtcaatcaagaaagagaaaaagaaagagagagagagagagagaattctttttccttttctttcaaggaaaaatcagaaaatgagtggttgatcttagttcaattaaagaaaacaaaacaaacctgctgggtgcctcctctgctctaaatactaagcaagaaataaagtgaataagcccctgccagtcatgtaactaaactctgaatgagggaagtagctaaaatgt

SEQ ID NO: 1509 - DNA, 400 bp, Homo sapiens
atcatagtaaagtagtaaattcatagggaatgaattaatctcctttttgttttgttttctctgaaaaagagggtgtgattacagcatatattgattgggtactgattatgggacattttcattgtatttgttgttgttgcagtagactaaatgtcgagcccgtgaatctcttgtgttggcattgtcagaaaaaagttgtatttttttttaaactggtctaaaaggaaaaaaattgaacatatatctttatattttttttgctctcttctcaaccatgtttagtgttttgtttatattcaaaggattttattttcacacttacaattctttacttgtctgtcattcaaatctttgttaccaaaacagtttgctctttttcatcattcactaagcattcctt

SEQ ID NO: 1510 - DNA, 401 bp, Homo sapiens
cttcacccactactctaaatctgatgaaacagagcagtaagaatttcttaggatatagcttaatttatttttttttaaaaagctcaatctaaaaacaagcttaatttaaaacagagacaaacaaatatgcctaactttgagttttgacaaaaaatgcaaaagtaattcaatggaggaaagatgagctttaaaaaaaaaaaagtgatactggagcaattggatatccaaaggcaaaaaaaaaaagtgcctaaattcatttctcacatcttatacagaaattaactcaaaattgattacagacttaaacataaaatgttaagcaataaaactttaggaaacaaacaggagaaaatgatgaggacctaaagctakgtgaagaacttctagacttgatactaaaa

SEQ ID NO: 1511 - DNA, 402 bp, Homo sapiens
aaaatgtactgcacaattggcgtgcaatagagtagtcaaagaaccaatgaaatgyaaaaagttatctatatggagatctcaaaatgaattaacaaattaaatcctttgacattgtatgagatcccattagggttcattgttacagttttctttaatgtttctaaaatagaaatgttgtcctgggcagagcagtgtaatgtgtacttgctttggcatcaaatgccacattttttttttttttgagacggcgtcttgctctgtcacctaggctggagtgagtgtgcagtggtgcaatcgtagctcactgtagcctcgaactcctgggcttaagcaatcctcccacctcagcmtcctgagtagctgggactacaggtcccagstgcccagctatttttaaaattt

SEQ ID NO: 1512 - DNA, 402 bp, Homo sapiens
aaaaccccgtctctactaaaaatacaaaaattagccaggcgtggtgatgagtgcctgtaatcccagctactagggaggctgaggcaggagaatcgctagaacccgggaggcagaggttgcagtgagccgagatcgtgccactgcactccagtctgggagacagagtgagactccatctcaaaaaacaacaacaacaaaaaaagtgtacatactgcatgatacaaaattctaagaaaagaaaactaatctatataaaaatttttctctgttattctctactgagaggggatgaggaggattaccaaggggcaaggaggaccttttggaggtgatagatgtgtttattactgggattgtgttgatggcttaccaggtatctatgtaagtcacaactcatcatat

SEQ ID NO: 1513 - DNA, 401 bp, Homo sapiens
tactgtaaatatgtgcaggctgggcgtggtggctcatgcctgtaataccagyactctggaaggccgaggtgggagaattaaggccaggagtttgagacatagcaagatcytgtctctagtaaataaataaataaataaataaataaataaataaataaatgcacttttttgtatattgagttatatctcaatgaagctgcttttttttaaaaaaaaaaaaaacatataacataaaagagattaacagaagagattcaaaagtctagaacaccaaatattaaaggtagcttttcaaatcagtgagaaaataatgatattacagaaaatggcaaatcatctagaattaaatttctacttcatactatcagcaatataaattgcagactaatctaaattaacaa

SEQ ID NO: 1514 - DNA, 401 bp, Homo sapiens
aggggtaattagacatcgactgtgtagtcaacattatgatcaggctatataaaatcatgaaacatcatcctaaactttaaagaactttgagtttagctgggaaaatatgctcacaggaaataattatgtaggaaaagaaggcatcaaaagggcttaaagcaaccaatcacacagagtttccttgttgggaccccccccccacccgccgggccccaccccgttgatatcctaaatgttctcttgacatcttggatttaccatagagcctagtactgtctgtaaggtcctgggcctgttctaattagtgctgagtatctgttgatctgctacgtgcaaatgggaagataaaactaaatgttagattagggtcaatctttaaaactctttcctagattgtgatg

SEQ ID NO: 1515 - DNA, 402 bp, Homo sapiens
aagtttttttcatcatgtcctgcttttacaaaccaagatctaatttgacatgattacgtaattgtgtggccatttgtgcccttccttctcctcctcctttctctaaagtagaaagcctctctttcctagagcctatgtaaaatgtgttaattcgcttaatagcaataataattttcttatgacaatttatctattcactaaagtgttattaaggacctattagttggaagcctctgtgccagctgttgggaatagaaaaatttataagacactgtctttggagctttcaatctagtgggggattcaaacaattaaagagatacttttaaaagacagtgtaataagtactctggaagatgtggcagactgccagttgccttccccagcataacattttcccaa

SEQ ID NO: 1516 - DNA, 402 bp, Homo sapiens
tcctggactatgaggtaaccttgggagtactagggaattgggatgctagtaactttctagaagcaccaactcagccccagaatgcctcctgctgacttcttttacgtgggagagtaagcatttgtgcatttaagccactatagttggatatttgaccattgcagacaaaaataagatcaaccgatagaatgccatttatgaaaaaaaaaaaaaaaaaaaaaaaccatgggagtggttctcctctctgttatgatagggagaggtcagagatgctgtccctgaagaagtgacattcacactgagacttaagggagaaatgagtgagcaaggtataggaaagtatttaaggaatatcatctgaagctctgaattagaagctatctacaagatactaaaagaaga

SEQ ID NO: 1517 - DNA, 402 bp, Homo sapiens
gaaattatgaggggttgtggracttttctatattttgatcttgaaaattatataactatatacttgtgttaatcttgtagaagtgaacactaaaaagggtgaattttattataaacaattttttaagagaacaaaaaatgtactataatcccaccagccaataacacactattaacactttggcgtacttctgactagtctttttttttttttttttttttttttgctggtgtttcaaaatgtcattatgatcatataatacacaaatatacatatatgtgtgcatatagatatctacagatgactaagatagatgattgatagatgatagatcagtgaatagataaccaaactcaaaacaaaatagttaattcatgcaacttgcacaaaaggtacaagaaa

SEQ ID NO: 1518 - DNA, 403 bp, Homo sapiens
gaaaaggacttttwtgtttgtttgtttttgagacggagtcttgctctgtcgcccaggctggactgcagtggtgcgttctcggctcactgcaagctccgtctccctggttcaagcgattctcctgcctcagcctcccgagtagctgggattacaggcgccagccacaacgcccacgcccagctaattttttttttttttttttttgtagtagagacggggtttcaccatgttggccagattggtcttgatctcctgacttcatgtgatccgcccgcctcggcctcccgaagtgctgggattacaggcgtgagccactgagcccggccgaaaaggactcttttttttttttttttacacagagtctcgctctgttgcccaggctggagtgcagtggcgccatctc

SEQ ID NO: 1519 - DNA, 401 bp, Homo sapiens
atctttttgagtgagtgttgccactttgacccaggcaaatgagaaataaaacaacaataccaaccagcagtttcaagtatccttctgctgcataataactcagcagtaggctttgctaatggtgtttatgagctgccaggctagaattggcccttaagcagggaggcatttgcccagtgggcttcttccatgtggggggggcctttttgcagcctgggggcccttttaggtgattctcagccggagcggtctcttcaggccaaagacttttgcaatgagctaactatgttcaattattgctttcagatccaccctacattcaaatgttttgggacaccaatgtaataccataaaaatgactgtgtaggacacgcctatgctaatgtcatgactggtttgtt

SEQ ID NO: 1520 - DNA, 401 bp, Homo sapiens
gaccatcctggctaacatggtgaaaacccgtctctactaaaaatacaaaaattagccrggcgtggtgtcaggcgcctgcagtcccagctactagggaggctgaggcagaagaatggcatgaacccaggaggcggagcttgcagtgagccaagatcgcaccactgcactccagcctgggcgacagagcaagactccgtatcaaaaaaaaaaaaaagaaagtttgggcaaaacctagagtttcagggaaagtcatttgaggtttggtttaggcaggaaatagaacaaaaccagtgtactaaggagaatacagtggaaataagagggaaaggaatgaagaaactggtaggctactaaaatgcccaggtacaaactactgaacatccacctttatgctgtcagtg

SEQ ID NO: 1521 - DNA, 401 bp, Homo sapiens
tcaggcgtagtgaacatacaccacgcaacctcccattcagagaattcttgtgcaaagaaggattccaaagggtttcagaaatactaaacttcttgaaattgaaattgaaattgaaatccttcttggcttctctacctgttacttcctctgcagtgctcagtatagtgtctgctctccctcctttctttttcttttttttttgagacagattttcactcttgttgcctaggctggagtgtaatggygcaatcttggctcaccgcaacctctgcctcttgggttcaagcgatactcctgcctcagcctcccaaggagctgggattatagtaccacgcccagctaattttgtcttttcagtagagatggggtttctccatgttggtcaggctggtctccaactc

SEQ ID NO: 1522 - DNA, 404 bp, Homo sapiens
aggacacaggaatattaatctggagaagcctttgataatagaatatagtcaaagttgacattgtgctagaatatttgaattttttattttccagaaattattttcactctttgctacatttactgtttgacctcaaaagaatgtaaaagcaagtttttaaatacaccattatttcctcaagaggctacagaattgctggaattttttttttttttttttggaatggagtcttgctctgccacccaggctggagtgcagtggcaygaccttggcacactgcaacctccacctcctgggttcaagcagttctcttacctcagcctcctgagtagctgagattacaggtgtgtgctcccatgcctggctaatttttgtatttttagtagaggtggggtttcgccatg

SEQ ID NO: 1523 - DNA, 402 bp, Homo sapiens
tggaattgagttatatgggagtcaattattcggtcacagcactggattaggaggttgagttcttgatagatttactttcagctgacctgtgtgacatttggtatttggttttgcaactttgttttcagttttttccatgcaccaatactcctagaattttgcttttgcctcttttcttccctttcatcttttttttttttttctgtagaaagcatacatccatatagaagacctctctcaatacattccagatctgagttgcagtgcagcacttagcttagcttgtgaaacactccraagacttgattaatatcatcctatggagagatgtccttaagtaacttagaatggatcctttatttttccagtaaataaactctaaaatatgaggatttccaaggt

SEQ ID NO: 1524 - DNA, 401 bp, Homo sapiens
caagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaacmagaaatcatatactatcttagcaggcrtatggggaaaataagtgtgaggag

SEQ ID NO: 1525 - DNA, 401 bp, Homo sapiens
atattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaataatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaaca

SEQ ID NO: 1526 - DNA, 402 bp, Homo sapiens
tcagcttagggagattttgggctgagacgatggggttttctaaatatacaatcatgtcatctgcaarcagggacaatttgacttcctcatttcctaattgaataccctttatttctttctcctgcctgattgtctctgaagatagaccaatagcaggctctgaaattgaggtaataattaatagcttacctaccaaaaawagtccaggaccagatggattcacagccaaattctaccagaggtacaaggaggagctggtaccattccttctgaaactcttccaatcaatagaaaaagagggaatcctccctaactcatttcatgaggccagtgtcatcctgataccaaagactggcagagacacaacaaaaaaagagaattttagaccaatatccctgatga

SEQ ID NO: 1527 - DNA, 401 bp, Homo sapiens
tctattgaataggagtggtgagagttggcaaccttggcttgttccagttcttaaagagaatgctccccgtttttgcctgttcactacaatgttggctgtgggtttgtcatagatgtctcttattgttttgatatatgttccttcagtgcctagttttttgagaacttttaccaagaagggatgttggactatattgaaagcttttttgcatctattgagatgataatattgttkttgttcttaattctgtatatgtggtgaatcacatttgttgatttgcatatgttgaaccaaatttgtawcccaagamttaagcctacttggtcacggtgaatgaactttttgatgtgctgctggattcaatttgttagtattttgttgaggatttttgtatctatgtt

SEQ ID NO: 1528 - DNA, 401 bp, Homo sapiens
gttagtaacactgattagaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcaggcatgttattctgttarcrtagttcacgttgagtgtttgtattcatttgttgtttgtttgtttgtaagtaacaggttttgactaaaattccacggactgtggaacarcacacactggggtctatcggagggtggaaagtgggtggagggagtgggtcaggaaaaataactaatgtatactaggcttaatacctgggtgata

SEQ ID NO: 1529 - DNA, 401 bp, Homo sapiens
ggagagagatagggaaggggaaatgctgtcaaaggatccaaagtttcagttagacagaaaaaataaacttcagtgatctattgcacagcatggtgaccacagttaaaaataatgtatggtacatctccaaattgcttaaaaaaaaaaaaaaggtttcaaatgttgtcaccacagaaaaacaaaaacaaaaacaaaaaaaaacaaaaaaaacgaggcaaggtgatggagwtgttaattagcttgatttaaccttcctacaatgtatatgtgttagtccgtttttgcgttgctgtaaagaagtatctgaggctaggtaatttgtaaagaaaagtggcttattttggctcatggttctgtagactataaaggtagcgtggtgctagcatctgcttttggtgagg

SEQ ID NO: 1530 - DNA, 401 bp, Homo sapiens
tcctcccatcaaagcttgggatctctgggaacagggaaacatatcaagatattagaagaygtcaatgttatatatgcagaaatggtgaaaaatcaatgaatttagtaagttaaatttgtttgggtagcattttaaaaatatttaagtactttgacatatgttaccccctaatacacagagggtgctcagacagcatttgcttacaggagtgaaccctggccaaagctgttttaaccaagggacagtggargcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcag

SEQ ID NO: 1531 - DNA, 401 bp, Homo sapiens
gattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtktttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattgg

SEQ ID NO: 1532 - DNA, 401 bp, Homo sapiens
  misc_feature (1)...(401): n = A,T,C or G
atttttgtgtataatgataaaaaacaataaaagaaataaagctatttgatttggatgtacagagaaaaatccaagctatgggaagtacattgtgacccccaggtgtatacatatgtacataagctggggttaagctattgccttaattttagccccacccatgtacactctgtgacgctgcctgggattctacaaatcacrtttatcttttgccactaagctccctgttaggatctgccaatcagaggacgctaggggcggactggaaggctgagtggggaagaaggaagacacttcctgtttgcttcctgttctgtttaacgacaccctaangattacttttcatttcagcagttatagtttgtttcagtagcaacagttatttccagttttagttttga

SEQ ID NO: 1533 - DNA, 401 bp, Homo sapiens
  misc_feature (1)...(401): n = A,T,C or G
tatgtgtttattagttaaaataaataattgactttccttgtactgtctttttctggttttgatgtcagtgttgtttagctttgaggaatgggctaggaaatgtttcatatattttgaaataatttgtataaattggaattatttgtttcttaaaggtttatggaacatctaaagaacaaattcatctggctctcatacagkttttaggatactactttgattgacatttcagtttcttttagatctatatcttctatttttcttgaggctattttgataattatttcttaagatattatcaattttcatctagataanaaaatatatcattttatgtatttttaaattcatcgatatttccacttttcattgacaacattattaagttttattgtgtctct

SEQ ID NO: 1534 - DNA, 400 bp, Homo sapiens
tcactacagccttgacctcctgggctcaagccatcttcccaccttccaagtagttgggattagagtcatgagccaccatgcttggctccagttttcttatttgtttgccaagtggattgtcttcttttctgttattcaaacaaataaatatgcaaaacagcaaaaaaagttttgcagacacggtggaaatatccaaggagttttttaaagtatggggttcaatttgaattttactaccttctgaatataccttaattaatattgaaattgatcaatggattggagacatttgttaatgatcacaaaataattttgctgattaggatcaaacacagagtctccatgtaatgatttggaagggtgtttaatgaaagctgcaatattgcctacattgttttca

SEQ ID NO: 1535 - DNA, 400 bp, Homo sapiens
aaggagtttttttaaagtatggggttcaatttgaattttactaccttctgaatataccttaattaatattgaaattgatcaatggattggagacatttgttaatgatcacaaaataattttgctgattaggatcaaacacagagtctccatgtaatgatttggaagggtgtttaatgaaagctgcaatattgcctacattttttcatggactttgctggaagcatctttgaaacttaatggcaacttattattatattcaatggtctaataagacaaattcagaaaaaaattttgggctgatcccctgaagtttcaacatttaaatagtctaggaagtattggtgggtgtgtgattttattcccagatccttaataggctgttaagtaggtggctccaca

SEQ ID NO: 1536 - DNA, 400 bp, Homo sapiens
ccacaaaccagttacaaataaacaaatttggcctcagttggaaacctggctacacagcaatgcctccattgactagagtcagtcagttgcatgtttctattttgcaaaatcaatccaacaatcatttactgaaggctcatagagtattgctctgggggatattgaaatgaatatagataaaaagcaagaatgtaatcttaatgtcttctgtttagaatagcttctacttcacaaggcctttttgttttgtcattcattttcaaattaattaaaatacagctcattattttccaggcacaaatatttgctcactatatttaaacatataaatatttaaacacataaatgtccactgctaattgccaggcaattagcagtggacatttgactgcaaatggag

SEQ ID NO: 1537 - DNA, 400 bp, Homo sapiens
taagctacttcactatgttttagatgctcacactgtatctttcttcacgacttcataataaagattaagcgttgtgttttggatagtccacgttgtgctgtaagtgtgctactaaattccataccagatactgcctctgagaagcttcagaagaagcaatgaattataaagaatgctaatgcgtagtaaccaggggttacwggtgggaacatcacaatcactacctaggacagctgaaattcctagaagcagggaattgaaccagggaccaaacaaggtccctatcagctctttagctctggactgaattgagaaagtattattgtttttaactggttcccatttggccttattaagagtttaattgtgcttttactctaaccttttatcctcttgacat

SEQ ID NO: 1538 - DNA, 401 bp, Homo sapiens
atagtcatggatcctgcacctgctctaagacaggctgttaagtgaggcttcctttcggagactgcaaattcaggactccaggcccctcagaatggttgtttcatgatttatagctggaggtgtgtacttctgtgtgctgttggtcaatgatgataaagtaggtatcagtgcctctgtgaattttctgttgccctttcatarccaccatttaggagcatttaatcaggaataaagtgctaggggtgggaaaaccatttcaggttgccattgcactgtggaggcaattgtggacttttcccccccatattttctaaactactaaaaatagtgtttcacatttacctgcataattttatgtctgctctttccctgcttgagcagataacatgatgacagcttct

SEQ ID NO: 1539 - DNA, 401 bp, Homo sapiens
gtgaggcttcctttcggagactgcaaattcaggactccaggcccctcagaatggttgtttcatgatttatagctggaggtgtgtacttctgtgtgctgttggtcaatgatgataaagtaggtatcagtgcctctgtgaattttctgttgccctttcataaccaccatttaggagcatttaatcaggaataaagtgctaggrgtgggaaaaccatttcaggttgccattgcactgtggaggcaattgtggacttttcccccccatattttctaaactactaaaaatagtgtttcacatttacctgcataattttatgtctgctctttccctgcttgagcagataacatgatgacagcttctctgacccctaattttccttttattttcaactttgaccatgg

SEQ ID NO: 1540 - DNA, 401 bp, Homo sapiens
ttctgaacagcatttaatcatactgaacaattattcataccttttcttaagcatatgttaatcatattagaaatgccattcccttctcgtgcaaaagggcaaaatcagcaacatccttccaatgtgggtgggtaaatgaaggctctgatacaagaattgaaatgaaatatgtgtgcaaacagttcttagtactgagctgtwtaaagaaggcctacctttgcacagaaaatgtctataagaattactcattaatgccacttaatagaggaagagtaggagataacgtgggaacagggtctttttaaaaaataccactttaaagaagaggcttatgcttcatcatagacaaaatgctttgtatagtactaacaggggcatatctattcctttaatgacactct

SEQ ID NO: 1541 - DNA, 401 bp, Homo sapiens
tcgtctctgctaacaagtttgcaatctagttggagagatgggagtaaaactcctgaaaaacttgggctcaataagataacatgatcaagagtgaggagacatgatatagactgcaaatgcagggaaagtgcactttgtggagtggtcactccagtgtttagtatgtcagaaaggaggcttcatggggcagacggatctcamaggatgcctaagttcagcagtggattgtttgcagaaatggcctaattcttcccctgcttgtatctctgctctttggcattgcaacttttcaggtccttatgtgaagaggtagagtctactcctctgcccctggccttgtaatggtggcaatgttgacgtgctaattctgattctagacctcaagagacctcgcacatctc

SEQ ID NO: 1542 - DNA, 401 bp, Homo sapiens
tggagagatgggagtaaaactcctgaaaaacttgggctcaataagataacatgatcaagagtgaggagacatgatatagactgcaaatgcagggaaagtgcactttgtggagtggtcactccagtgtttagtatgtcagaaaggaggcttcatggggcagacggatctcaaaggatgcctaagttcagcagtggattgttygcagaaatggcctaattcttcccctgcttgtatctctgctctttggcattgcaacttttcaggtccttatgtgaagaggtagagtctactcctctgcccctggccttgtaatggtggcaatgttgacgtgctaattctgattctagacctcaagagacctcgcacatctccggccactctattgaaacacaaccagctgc

SEQ ID NO: 1543 - DNA, 401 bp, Homo sapiens
caggttaagtctgctggaggaagagaccacattctttatgagatgagatgtttcagcagaagccatgggagactagatagcccccagcagagccatcaatgaggtcaacagaagaactccaccctagctgaacccagtccaaattgccaacttgcagaatcttgggctaaatgaaccaacaggtcaccaaatgttgaagtrgtttgtcatatagtgacagataactgatacaaatctggaaggtagagaggaagaaagtgttctaggccagagttgtacctcccaaaaagtcgagtcagaaatatgggaggccaggctaaagaaaagtaaagaaattagtaggattggatgtttgaaccactttctttcagtaaatcgctagaagcacccatgcagggttc

SEQ ID NO: 1544 - DNA, 401 bp, Homo sapiens
tcagaaatatgggaggccaggctaaagaaaagtaaagaaattagtaggattggatgtttgaaccactttctttcagtaaatcgctagaagcacccatgcagggttcaagtgaacgtatactggaggccagacctgcccaactatgctgctaaatggtgatcttctcctgaagcgctccatcagggtatgagtaacagggawctccccttgccaagacacacagggagtgtgatgaccctgtccctccaaactgcactttgagagaatggaaccttgttttgtagccaactatattatgccaagaacaaaaagatctttgtagcttatcatctgtttttatgttttatataaaaatctaaagcttctatgacatactttcaagaaactgctagaggcaacac

SEQ ID NO: 1545 - DNA, 401 bp, Homo sapiens
gagtaacagggaactccccttgccaagacacacagggagtgtgatgaccctgtccctccaaactgcactttgagagaatggaaccttgttttgtagccaactatattatgccaagaacaaaaagatctttgtagcttatcatctgtttttatgttttatataaaaatctaaagcttctatgacatactttcaagaaactgytagaggcaacacgtagaatcccagagtaaagatattatgaagttagagtactttaaaattcttcagttctcacagtgtggatctatcgcccattgaataacaactttaactgttttatgaggtcactgaatatatttttcactataaaagaacatgagagaaaatatttaccttgaaatgctaaaaatgtgttccctttc

SEQ ID NO: 1546 - DNA, 401 bp, Homo sapiens
atgttttatataaaaatctaaagcttctatgacatactttcaagaaactgctagaggcaacacgtagaatcccagagtaaagatattatgaagttagagtactttaaaattcttcagttctcacagtgtggatctatcgcccattgaataacaactttaactgttttatgaggtcactgaatatatttttcactataaaakaacatgagagaaaatatttaccttgaaatgctaaaaatgtgttccctttctgtggaatggcatttgttgaaaggaatatcccgggagaggatggattcttgttttagacatagctctttaaatttggcaggacatgtgggggtagggggacagatgggggtggagttgggggagcttggtattcaggtggcacaatacca

SEQ ID NO: 1547 - DNA, 401 bp, Homo sapiens
tataaaaatctaaagcttctatgacatactttcaagaaactgctagaggcaacacgtagaatcccagagtaaagatattatgaagttagagtactttaaaattcttcagttctcacagtgtggatctatcgcccattgaataacaactttaactgttttatgaggtcactgaatatatttttcactataaaagaacatgaragaaaatatttaccttgaaatgctaaaaatgtgttccctttctgtggaatggcatttgttgaaaggaatatcccgggagaggatggattcttgttttagacatagctctttaaatttggcaggacatgtgggggtagggggacagatgggggtggagttgggggagcttggtattcaggtggcacaataccaggtggagg

SEQ ID NO: 1548 - DNA, 401 bp, Homo sapiens
attcttcagttctcacagtgtggatctatcgcccattgaataacaactttaactgttttatgaggtcactgaatatatttttcactataaaagaacatgagagaaaatatttaccttgaaatgctaaaaatgtgttccctttctgtggaatggcatttgttgaaaggaatatcccgggagaggatggattcttgttttagwcatagctctttaaatttggcaggacatgtgggggtagggggacagatgggggtggagttgggggagcttggtattcaggtggcacaataccaggtggaggttaaatacctacaactccttatgcctgggatcttttgttccaatagccatagaagcttctttcatttcactttttatttttattttttgcaaaacccatt

SEQ ID NO: 1549 - DNA, 1006 bp, Homo sapiens
cggtttttttgccttttctattttgccttttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcackcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgrgggcctcggtgtgctactygtccccgcccagcgtgggatcggtgcaggagctagctcagcgcgccgcggtggtgatcgagggaaaggtgcacccgcagcggcggcagcagggggcactcgacaggaaggcggcggcggcrgcgggcgaggcaggggcgtggggcggcgatcgcgagccgccagccgcgggcccacgggcgctggggccgcccgccgaggagccgctgctcgccgccaaygggrccgtgccctcttggcccaccgccccggtgcccagcgccggcgagcccggggaggaggygccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcg

SEQ ID NO: 1550 - DNA, 401 bp, Homo sapiens
ctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcackcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctac

SEQ ID NO: 1551 - DNA, 401 bp, Homo sapiens
ctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcrgcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaa

SEQ ID NO: 1552 - DNA, 401 bp, Homo sapiens
tcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaaygggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcag

SEQ ID NO: 1553 - DNA, 401 bp, Homo sapiens
tgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggrccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtac

SEQ ID NO: 1554 - DNA, 401 bp, Homo sapiens
gcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggygccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgag

SEQ ID NO: 1555 - DNA, 401 bp, Homo sapiens
ctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccytgggggcgcgaacccgcggcgaggagggcgcatcccgggcgcgcgggcagcggggctcgacggccgcccgagcaaggcagaggcgctctgggtcccagttgttggtttcagggtggtgggttctcagcgatcctcagagagggaggtttcgctttctccagcttcccttgtcttaggctttgccactggagaaagcccaa

SEQ ID NO: 1556 - DNA, 401 bp, Homo sapiens
gccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccttgggggcgcgaayccgcggcgaggagggcgcatcccgggcgcgcgggcagcggggctcgacggccgcccgagcaaggcagaggcgctctgggtcccagttgttggtttcagggtggtgggttctcagcgatcctcagagagggaggtttcgctttctccagcttcccttgtcttaggctttgccactggagaaagcccaagtttagtcctggg

SEQ ID NO: 1557 - DNA, 401 bp, Homo sapiens
ggagacgggccggaacctcaagaaggaggtcagccgggtgctgtgcaagcggtgcggtaagttcctcgcccttgggggcgcgaacccgcggcgaggagggcgcatcccgggcgcgcgggcagcggggctcgacggccgcccgagcaaggcagaggcgctctgggtcccagttgttggtttcagggtggtgggttctcagcratcctcagagagggaggtttcgctttctccagcttcccttgtcttaggctttgccactggagaaagcccaagtttagtcctgggttggggcctcctgaaactttttaatcctttggggtttggctcaccaagtagatcggaaatgtgccggctgctttcttgtgggtgatatgaacttggctttggttaggagttgctga

SEQ ID NO: 1558 - DNA, 401 bp, Homo sapiens
atttgtggtggttaagtcctgctgttaattaatacctgatgatttggttttaatgacagcaaagatcattgttcacccaccattcccttatctgaacaatgtactttgtatgccagagacctgttaggattgcaccactcagtggacagaagctgttcagagagtggtgctgaagaaagctaagtggcatagggattcccygagacccactgatagatgtcactccaaagcatgggaaatgctctgctgggagctgtcttattaggcaaccgaaaagctcagcaccatcgtactgcagcatatgttactctgttacagaatctgaaacaaaaccttttaagcaacaccactgtccagttttcatatgttttatagtgtgtaattcaggaaggatttttcct

SEQ ID NO: 1559 - DNA, 401 bp, Homo sapiens
tcattttatgcagaaaattggaaaggagcagatgtttattcctaagctagaattttgaaggccaacaattaaaataaacatgtctctgccaaaacttgaactaaattgaaaaatttagcatataaattaaagctcacttaaaactaaatttatcaaggaaatacatttgttttgcattgctggtttcaattattctgaaargacttttatttttatggaacactgaagatttttaaaagtttcaaacaatttattggacaattgcaccatttaaaatgagttacaaatgtcttgcttaaatgtatgagctattagcacatagttgatgaccttatagagagacattaaagcaaccatatcctcaagtttatgtctatattcccaggggagtacaagaaact

SEQ ID NO: 1560 - DNA, 401 bp, Homo sapiens
taatggagagattagcatggattagattagcttgtgtacaaaggttgtacaaattgattgctgtgatttgtaggctgggctgatctttatagtcactggcatgacttcttaagcattatagtcatgatttctttcatgtggtttacatgtggcaacaagaaaagcacatttccctcgttaccaaaaccttgtgtctcccartgggaacttgacatagactcaaaaacataagacgtgtacatataatattaaggagatggcactggtcatctggcctgctgtctgggatgacagcacacattggccaaagacagaagagttcccaaaacagatgttcagagaagatggctagaatactgttgaaatgtggtctagaataattatgaacataagcctaaaaa

SEQ ID NO: 1561 - DNA, 401 bp, Homo sapiens
acctgatgcctataggttgaggaaattgtgtatttgtgaatagtaatagcacagcagccactaggcctcccagtcgtactggagatttctaaaaggcaaagtgtttttagtttgttttaggtaataggttgatatttagcctattaaaaaggcagaccctggcttgacagacaaaaattaataattaatttgggagccagrtacagacttaggttttttgaattcttgtttctatattcttattttggaagtttacagtttggttttatatgcaggggtgttagatgaaggtgtattgttttgcaaatagaaacagtctcaggagacaaataacaatggcatgagaaatttatgaagtttatttttagcagcactttcaggcaaggttttgccatcaatat

SEQ ID NO: 1562 - DNA, 401 bp, Homo sapiens
cttaaaactaggaaaaactgagctttaagggcccatgaaagtccttggcttgtgggtttgctggctctttgctagaattatattttgtttttttctggttcagggtaccgtaacagaaggtgggaagctatatttttcatgaaactgattgcttttctaattaacaatcttgctaataaagcaccactgtacagcagatayagtgtttttaatgtcatggatattgtacctgaaagtaagtgaagaagtgtcagatagtttctgccaatatttgagcagtcttagttctaactgctacaattatgcaaggtatttgtcttagaagagcaatggccatttgagtaagactttccatatggtgttccacagtcactgggagaaaatgggcctttttttttcct

SEQ ID NO: 1563 - DNA, 401 bp, Homo sapiens
gctttcattgcatcattagacagaattgtgtgaccattcccaaagagattgacagtgttcatggcaggctgtataggaatctttctgtgtgcaggctggtctacaatttagcataataaagatctggccttatattcataggatctagccaggaaaattagtcttacctcagggtttaaagaaatgagggtgtgtcccagrgggatctgtctgtggccagcaggaaatttaattttaaaaactgaagaatatacaatagttcaggcactgaataatttgagcctgcgaaggtgcttctgccacatatattatcatagtgttagtaaggccaggaaggtctgaagtttgtatgagttcacagatattttgaaagactcatgcaggtatttttgatatgattc

SEQ ID NO: 1564 - DNA, 401 bp, Homo sapiens
aaaataatcttctataaattatgcgtattaacacagatatgtagcaaactataaaggttattttgctctgaagaggaattcagaattagaacttggatgtagcaggacacctctgttctcattgccataaagaaaaaaaaaacaccttttatattgaatttcagtgaaccttgcagccagcatctgtcccattaattttcrtatacgagaacaatgtggcatgattactcaccagcaacagaagtagcagttttataaatcttatgttgtagtggctggaagggacagggttgtgctctcattgtttccatattctttgtgaaattcacctttgcagggggtggtttgctctttctcttccagatgtgcacagaaatatgccatgtcactaaacgtcatgt

SEQ ID NO: 1565 - DNA, 401 bp, Homo sapiens
gaggaggtttttgcaagtggttgtagcctggttttgaatgaaggtgaaaatgctctttttgttagctctagatcagcagaggtgaataagcatcatgaatttaggagactggcgtttttttttacataaaagttgctttgttgctaattagtagattagaattcctttaattgcattctgaccaaagacttttgggtgttyaggagggcaagttagcatgtgttgcatttgaatttatacatttgagacacattttcttactgaagctgatattcatgaagcagaaaagataaaaacttgtacatacctttttatttcttgattttaatgttgaagttctattctcagaatggattttataggcaacaatatgcacttaaatttatgatctgtttacgaga

SEQ ID NO: 1566 - DNA, 401 bp, Homo sapiens
aagttctattctcagaatggattttataggcaacaatatgcacttaaatttatgatctgtttacgagacctcactgtattttgacagaggtcaaaataagggaaatcaatcttggttctcattccaaagagttttttttcctgatatcttaaaaaggctttattacattatgttgatatccatggcagagagttccaaagrcatccccatgaaagggctataaatgtgaggtttgaaaccaaggcaagtcaagcagggtaagcaatcttttcacccaaggttttaaaataactgctgataagaccttctcacagattttcattcatttcttcctagttataggcaggaaattctgaaagcaggtgaattctaaaattaccttataacttgatttcagaata

SEQ ID NO: 1567 - DNA, 401 bp, Homo sapiens
caacaatttgtgagatagaatagtaacgacaaacatacataagagaaaaggcagaattagagtacagtattttaaaagctttcaggcgctcaataaatgctcactattgttaaagagagagaaaaaaggaagtcctgtataatacatcaataagattttaattttcagttattattatttgagctttatttcccagctctstgacacagatttaggggtggtgtggatattcttagagtggaaattattgaactcttagattaaaggtactcgagttcctagcttgccctgtaactacacatatagagaagatcactctcgtaggtgctagtaagtaggagataaaagttttagggggaaacacagagggatactcagaactgggagcagtcctaaggtgg

SEQ ID NO: 1568 - DNA, 401 bp, Homo sapiens
ggataggggagttgtgtgttcataatgccactttgccaccctgaaatctatgcagataatctacttggaaggctttgagccccagtggaatacagaaccatgtaagtatcctgcattgatttacagcacctgctacagctgcttggatcttggcaggcattttctctcctgccaaatgctgttgaaattgctgggctggtytagatggaggttatatttactggacatgtttataatcttcagagtgatctaagccatagagagctaatttcccaaagatcaatgactaagggaggatttcagaggttatcctctttatccaatttcctgtgtcctaatgagatggctgaaacctgtttggaatctttctgattaggaactcttgtgagagtcaataaaga

SEQ ID NO: 1569 - DNA, 400 bp, Homo sapiens
atctaagccatagagagctaatttcccaaagatcaatgactaagggaggatttcagaggttatcctctttatccaatttcctgtgtcctaatgagatggctgaaacctgtttggaatctttctgattaggaactcttgtgagagtcaataaagaatatgacattcataaatctaaataagaggcgacttggcagcctgtaggtgattcatgccacgagaagcctttcccctgcccccaacaggatgtgccatgggtggccaacctgagacaaggtcagacttgaaccaagagtcttgagaggacttggcctctcctggttaattcagaggactcttctggctattagaatgcgctgtgtatattttttacctgtcttgatttaattcaattcaattgcca

SEQ ID NO: 1570 - DNA, 401 bp, Homo sapiens
tccaaatgcttgctagctattttctgagtatcagttatatttaccatgatcctgaggagcagaccctttattgtgtcccagttcagtttgcatcgtcttcatacagcataaggcaacagtgatagaaataatctctagagtaatctccaagtacctttccaaagctgctatgcctcaagtacttcctttaacctttaagcrtctgccttgcatacagtcctcttgggccactcttggcaaaatatttggaaggagatctggaacctgattatttctcaatgaaaaaataatttgcttttgcactgggaagcgacagtaatccaatataagcatgccattgaaaaccttcatgccctactatttcttttaggacttttgtgaaccctttctctttgatacat

SEQ ID NO: 1571 - DNA, 401 bp, Homo sapiens
gcattctgtggctccatggtggattctggcatacttttttcaggatgctcttttccaggtcaatatttaaagaacttgaagaccgcaaagcttctgctcttgagatgagaaggagcttctcctccactaatgatctgaatttaacactggatcacttaaagccaggttcatttgcaaaatatttgctcagctttgatgctrtaaaagcctctccaaagctaaggaaaccctgagaaatggattattcatgtgactctgcagagcttggtatcaggcattgcttgtatttaatctttccctaagcattaacattctaagcttatgaaaaatttgtgacgtatgctaaatatattccatccagttatgatcagagtccagtcacctgagtgtaagatttctgc

SEQ ID NO: 1572 - DNA, 401 bp, Homo sapiens
gctactgggtggcctctgacatgatgtgtttagttatcaaacatgtcagctaataccatggagagaacacatgtattaaaagtgacagacataacaagggtcaaagattaaaggtgaattgcaaagggctttttactgcatctctgttgttataacagtttctagagtaggttgaatacatgagcaaaaagaatgatgagsagtcatggtgagcagaagctctcttctcaggcaaagcaggaatttttttccccacattgagctaaatattctttaaatgctataaatgttactacatatctgtgctgtttgtgggacagcacaaacatatttgaaacattcagcagttctttctcattaacttccatttttctaattttcattggttatattttcctgat

SEQ ID NO: 1573 - DNA, 401 bp, Homo sapiens
gaaaaaggatgttgcactgtatgtaataaaagctatgaattttggcacttttgtaaactgtaaagatgtaaatgttccttaattattttcagtagtcagacttatgtttcttccagttgtatttccaggctgagacaatacaaaagatggacagctctaagttgattatcaagctttaaatatgtttcacttgattaagarcattgaaggtgagaatggaattatgtaggcttcactgagtatccgtaaagttgggaacaatgatatacaacacagaaaagaagctccataagaaaacagctgcaactaacccatctggaaagagacctcaatcaaaatgatacttagcgaaagaaaaatactttcagtgatcaaattatttgtctgaccaatgcttggtg

SEQ ID NO: 1574 - DNA, 401 bp, Homo sapiens
aaaggatgttgcactgtatgtaataaaagctatgaattttggcacttttgtaaactgtaaagatgtaaatgttccttaattattttcagtagtcagacttatgtttcttccagttgtatttccaggctgagacaatacaaaagatggacagctctaagttgattatcaagctttaaatatgtttcacttgattaagaacaytgaaggtgagaatggaattatgtaggcttcactgagtatccgtaaagttgggaacaatgatatacaacacagaaaagaagctccataagaaaacagctgcaactaacccatctggaaagagacctcaatcaaaatgatacttagcgaaagaaaaatactttcagtgatcaaattatttgtctgaccaatgcttggtggaa

SEQ ID NO: 1575 - DNA, 401 bp, Homo sapiens
ccaattgctcttgtttggggcagagagcacagatttaagaaacaaggatacaataaaatgaaatttggctgcagtacaaggttaatgtctctcctcacctcccaaagagtaccaagggatcattcattgtcacagctgttggggtttagagctctcttctcatccaaatgccagtactttccacaaaaagctcttccccakggatgccctaataagccagtgtgtcctgtataggtgagacttgccctggctgtctctatccaagtggtgacataagctcatctaaagcctttcattaatgcaaacaatgacccagcccatggtggcactgattcttgaagctgaagacttggagaaggagcctgattttccatcacactgattgttgttttcagtaagat

SEQ ID NO: 1576 - DNA, 401 bp, Homo sapiens
aggtaaactggagagtcatctctggtctactttcctcttcagtttggtggaagtttcacgtaaaattacatgtgaaagtccttgagaattgaaacaatgggcaaatctatagcagaatgcttgttgaattctatcagctttcccaaggtgcaggctgcccatgtttagtctttctcactttccaatccattttccacactrcagccagcgtgttttttctcaatggaaatctgatcatatcaacctcttttttaaaaaaaatcctaaatatcttctccctctcacagaataaaaatcacaattccttaagaaactgtcaaagccttctcaatctgtgcctttcatctctgaccattggtatctttcttctgataggataaaagttcattgaatgttcaagc

SEQ ID NO: 1577 - DNA, 401 bp, Homo sapiens
gtttcacgtaaaattacatgtgaaagtccttgagaattgaaacaatgggcaaatctatagcagaatgcttgttgaattctatcagctttcccaaggtgcaggctgcccatgtttagtctttctcactttccaatccattttccacactgcagccagcgtgttttttctcaatggaaatctgatcatatcaacctctttttwaaaaaaaatcctaaatatcttctccctctcacagaataaaaatcacaattccttaagaaactgtcaaagccttctcaatctgtgcctttcatctctgaccattggtatctttcttctgataggataaaagttcattgaatgttcaagccttctcttttgcttttcagagcttggccatgtggttttctctgtctgaaaca

SEQ ID NO: 1578 - DNA, 401 bp, Homo sapiens
tttcacgtaaaattacatgtgaaagtccttgagaattgaaacaatgggcaaatctatagcagaatgcttgttgaattctatcagctttcccaaggtgcaggctgcccatgtttagtctttctcactttccaatccattttccacactgcagccagcgtgttttttctcaatggaaatctgatcatatcaacctcttttttwaaaaaaatcctaaatatcttctccctctcacagaataaaaatcacaattccttaagaaactgtcaaagccttctcaatctgtgcctttcatctctgaccattggtatctttcttctgataggataaaagttcattgaatgttcaagccttctcttttgcttttcagagcttggccatgtggttttctctgtctgaaacaa

SEQ ID NO: 1579 - DNA, 401 bp, Homo sapiens
  misc_feature (1)...(401): n = A,T,C or G
cctcatcttctttggctactgagttantaaccatccttcatttatctcagggagcaaaggcaggatttccgtgggtgtccaaggtccttactcacagtcaggatgcatggcagtacccttaataactacagattcagaatcacagaagacatttaccgantatgtattttctgccaaaccctgtgccaggtgttattagarcattacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaattcacatctgagttggttgcatgatgctatagttggcaacang

SEQ ID NO: 1580 - DNA, 401 bp, Homo sapiens
attacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaattcacatctgagttggttgcatgatgctatagttggcaacatgaytctgaccgccaccatcacaaatagaggttagaaaatattacttatgtgaaaataaatgccatttctggcacctaaaacagctcttttctcaccttcctatgatgaggttttattgagcttttgcaggaaagaaaagaaagaaatctgcattcaggtttcaggagtaaagaggctgctcattaacaaagccgtttcaaaat

SEQ ID NO: 1581 - DNA, 401 bp, Homo sapiens
agtgagtaaagtgcagtttctgctgcttggttactgtagttcattcggggaatttcatcttggtcgtgttgaatgcagtggttagatcctgtgaagttgtttaattaaaggtgttctagtagtcaaagccatgtctaaaaccccgtttgtttaattctttagtaatgtcaacattcctaaatttcatgtagcctaagagayttttccactggcttcaaatctgagctttgccactttggtgtcctttgctatgaatgttcaatgaggcgttctgagatcaccaagaatagaagagacacacccccggctgtcagaagtttaaccttggagaatgccatgaagggcaattctggaagaaaaaagagaagggaattcctcgtaggtttaagatcagaaagtgg

SEQ ID NO: 1582 - DNA, 401 bp, Homo sapiens
ggagacaattgttatttttaaaaatgtctttcttattttaactacaaggacttggcttgcttagaggctcttgctcaggagtctttaaatgcaaatgagggaaaccccaggttataaagcatctgcttctgcaggttttcaatcctgttaccttagcaacatttgcccttgtattccacgcatcaccttgacagcctgcakaatataagggacggagcggagcaggggctcggggtgggagcctggaaagaaaactggggctcaaggaggtttaatatcggttagtagcttgggatccttcggataacggctgggcaatgaaaataaaaagccccatttccagaaatcaaagaacttggggagaaataaacacgctggttcaaaggaggggaaaatatatc

SEQ ID NO: 1583 - DNA, 401 bp, Homo sapiens
aattgttatttttaaaaatgtctttcttattttaactacaaggacttggcttgcttagaggctcttgctcaggagtctttaaatgcaaatgagggaaaccccaggttataaagcatctgcttctgcaggttttcaatcctgttaccttagcaacatttgcccttgtattccacgcatcaccttgacagcctgcataatayaagggacggagcggagcaggggctcggggtgggagcctggaaagaaaactggggctcaaggaggtttaatatcggttagtagcttgggatccttcggataacggctgggcaatgaaaataaaaagccccatttccagaaatcaaagaacttggggagaaataaacacgctggttcaaaggaggggaaaatatatcagaact

SEQ ID NO: 1584 - DNA, 401 bp, Homo sapiens
gaggcaggccatctgctgcagtgtttccctggaaacccccagcaacgcccctcccggagctcctccgcggtctcccccactccatccccgcgcagcggaggagcttgccggtgatgtcactgctgctagctgggagggaatcccaggacctgcgtccctcgggtagagccaatcatggtcggctctggatgctggaaaccyggggcttttaaccagaaagaattgcaaaagcaatatgcaattcatcacagtccacaaagcacagttcctaacagattctgaaaacgtgattttaaaaaaaatgagatttatccgtaaacgagggctaggctacagttggtagggcggctgtcaattcttctacggagttttaacctacactcaatggatgcatgaaaaaa

SEQ ID NO: 1585 - DNA, 401 bp, Homo sapiens
tttccctggaaacccccagcaacgcccctcccggagctcctccgcggtctcccccactccatccccgcgcagcggaggagcttgccggtgatgtcactgctgctagctgggagggaatcccaggacctgcgtccctcgggtagagccaatcatggtcggctctggatgctggaaacctggggcttttaaccagaaagaatygcaaaagcaatatgcaattcatcacagtccacaaagcacagttcctaacagattctgaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagc

SEQ ID NO: 1586 - DNA, 401 bp, Homo sapiens
ccactccatccccgcgcagcggaggagcttgccggtgatgtcactgctgctagctgggagggaatcccaggacctgcgtccctcgggtagagccaatcatggtcggctctggatgctggaaacctggggcttttaaccagaaagaattgcaaaagcaatatgcaattcatcacagtccacaaagcacagttcctaacagawtctgaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatat

SEQ ID NO: 1587 - DNA, 400 bp, Homo sapiens
ctccatccccgcgcagcggaggagcttgccggtgatgtcactgctgctagctgggagggaatcccaggacctgcgtccctcgggtagagccaatcatggtcggctctggatgctggaaacctggggcttttaaccagaaagaattgcaaaagcaatatgcaattcatcacagtccacaaagcacagttcctaacagattcygaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatat

SEQ ID NO: 1588 - DNA, 401 bp, Homo sapiens
gcggaggagcttgccggtgatgtcactgctgctagctgggagggaatcccaggacctgcgtccctcgggtagagccaatcatggtcggctctggatgctggaaacctggggcttttaaccagaaagaattgcaaaagcaatatgcaattcatcacagtccacaaagcacagttcctaacagattctgaaaacgtgatttwaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatatatttcattataattgt

SEQ ID NO: 1589 - DNA, 401 bp, Homo sapiens
  misc_feature (1)...(401): n = A,T,C or G
taggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatatatttcattataattgttgcttctgcagaaaattgggatagaaatctcrgatgagctgtagttacacggagatctacagcaatgcaatgtttagctagcatgcattttgtcatccaaggctagtaggtgaaatatttcctttacctgtcttgatgcacggtggagaaangagacccgcttcgttttccctctaatctagagagttaacctcctccaggtagggttgaaaatatgaacagagctgctttt

SEQ ID NO: 1590 - DNA, 401 bp, Homo sapiens
cactcaatggatgcatgaaaaaaagaaatgaaatgatttttttagctactttaaaaaataaaggtaatgaatatttcttatctatatgcatatatatatatatttcattataattgttgcttctgcagaaaattgggatagaaatctcagatgagctgtagttacacggagatctacagcaatgcaatgtttagctagcaygcattttgtcatccaaggctagtaggtgaaatatttcctttacctgtcttgatgcacggtggagaaatgagacccgcttcgttttccctctaatctagagagttaacctcctccaggtagggttgaaaatatgaacagagctgcttttgcaagactgtgttgcctctaaatgtgatttaactcgcatattcagaatctta

SEQ ID NO: 1591 - DNA, 401 bp, Homo sapiens
  misc_feature (1)...(401): n = A,T,C or G
actgcaaccatcacatgtggctctcagagcttctagttccctggaaacagganttctatctgccatcaccaggtataaggtgccaccacttgaagggatctgccctatcaaaaatgaggaaatatattgatcaaaatggctggagaaagtgaccagccaaaacacagcttcacagtcttgcctgttttaagtagattctayttccattttgccggtgacagcactaagcaaataagcaatgttgccaatccgagaacagcctgcattcaaggtattcaatcaatcaaagagagacaatggcattctctcaaagatcagatgttttgtagtgcaactatgttgttctgtttttctttacttcaattatcagatagacaggaaaaaatacaacaaaatagcat

SEQ ID NO: 1592 - DNA, 401 bp, Homo sapiens
ctggagaaagtgaccagccaaaacacagcttcacagtcttgcctgttttaagtagattctatttccattttgccggtgacagcactaagcaaataagcaatgttgccaatccgagaacagcctgcattcaaggtattcaatcaatcaaagagagacaatggcattctctcaaagatcagatgttttgtagtgcaactatrttgttctgtttttctttacttcaattatcagatagacaggaaaaaatacaacaaaatagcatgtagttgatttgccaaaaataaatagcaaagaaaaaacaagaataactagaaaacacgtgacaattttagaaaaaatgtaatcacatttccaattactagacaagatataaataaagagcatttataaaatgtttaaat

SEQ ID NO: 1593 - DNA, 401 bp, Homo sapiens
aagagagacaatggcattctctcaaagatcagatgttttgtagtgcaactatgttgttctgtttttctttacttcaattatcagatagacaggaaaaaatacaacaaaatagcatgtagttgatttgccaaaaataaatagcaaagaaaaaacaagaataactagaaaacacgtgacaattttagaaaaaatgtaatcacrtttccaattactagacaagatataaataaagagcatttataaaatgtttaaatccattcttttaaaacgataaacaacttctctaactggaaattactgtgcagctgctactttgtattttattggtataaaataactttagagttctatttcattgcattgcaaaggtgtaatactttgccataattaggtttaaatct

SEQ ID NO: 1594 - DNA, 401 bp, Homo sapiens
attctctcaaagatcagatgttttgtagtgcaactatgttgttctgtttttctttacttcaattatcagatagacaggaaaaaatacaacaaaatagcatgtagttgatttgccaaaaataaatagcaaagaaaaaacaagaataactagaaaacacgtgacaattttagaaaaaatgtaatcacatttccaattactagrcaagatataaataaagagcatttataaaatgtttaaatccattcttttaaaacgataaacaacttctctaactggaaattactgtgcagctgctactttgtattttattggtataaaataactttagagttctatttcattgcattgcaaaggtgtaatactttgccataattaggtttaaatcttgcaaaaatagaaac

SEQ ID NO: 1595 - DNA, 401 bp, Homo sapiens
atcagatagacaggaaaaaatacaacaaaatagcatgtagttgatttgccaaaaataaatagcaaagaaaaaacaagaataactagaaaacacgtgacaattttagaaaaaatgtaatcacatttccaattactagacaagatataaataaagagcatttataaaatgtttaaatccattcttttaaaacgataaacaacytctctaactggaaattactgtgcagctgctactttgtattttattggtataaaataactttagagttctatttcattgcattgcaaaggtgtaatactttgccataattaggtttaaatcttgcaaaaatagaaacctgcattttttggttttatattagtttttttaggtgatgctattcaatgggaggatataattgc

SEQ ID NO: 1596 - DNA, 401 bp, Homo sapiens
aaaaaacaagaataactagaaaacacgtgacaattttagaaaaaatgtaatcacatttccaattactagacaagatataaataaagagcatttataaaatgtttaaatccattcttttaaaacgataaacaacttctctaactggaaattactgtgcagctgctactttgtattttattggtataaaataactttagagtyctatttcattgcattgcaaaggtgtaatactttgccataattaggtttaaatcttgcaaaaatagaaacctgcattttttggttttatattagtttttttaggtgatgctattcaatgggaggatataattgctgtttctatgaccttgggtaagtcatttaacccctctgaaccttggtttccttctttggttgaaaat

SEQ ID NO: 1597 - DNA, 401 bp, Homo sapiens
taaaatgtttaaatccattcttttaaaacgataaacaacttctctaactggaaattactgtgcagctgctactttgtattttattggtataaaataactttagagttctatttcattgcattgcaaaggtgtaatactttgccataattaggtttaaatcttgcaaaaatagaaacctgcattttttggttttatattagwttttttaggtgatgctattcaatgggaggatataattgctgtttctatgaccttgggtaagtcatttaacccctctgaaccttggtttccttctttggttgaaaatagagacagtaatacttgacctctctctccagattttgatcaggttaaagaggccaataaaaatgaatgtgattttgtaaatagtgatacacaca

SEQ ID NO: 1598 - DNA, 401 bp, Homo sapiens
gtttgaaggtaagtgttttcagaccctggtttcctaggaccaagtcttggcctcatcaaacataatcacagtctccttttaccactttggcccaaacactatgaagccttttgcccactggctcagcttctcttgccatatactgattattaatgccagtaaaatacctaggcaccttggcagtaacttacgcaaatatgyatatttctaattacagggaaattgttagaacatgacttggattagagatacacagctaataattcaagaagaaataatgctttgttttcagtagaggaaaataaaagcttcatttgaataatttttcctcctttctctccctttttgttttgatacttacgcatgggcaataccgtaaactggcaataaaagaagttatc

SEQ ID NO: 1599 - DNA, 401 bp, Homo sapiens
taattacagggaaattgttagaacatgacttggattagagatacacagctaataattcaagaagaaataatgctttgttttcagtagaggaaaataaaagcttcatttgaataatttttcctcctttctctccctttttgttttgatacttacgcatgggcaataccgtaaactggcaataaaagaagttatcgcaaacaktgtggccatttctcctcagacactggacatcctacatctgttatatggtttaccatccatccacttccttgctatagctccaggtccacaattctttgtcatgtcattgctcttgacctataccatgactgataaccatgtacatttttaagaaaaaaatgtaaattaattaaaataatttaaaaacacatatccatatg

SEQ ID NO: 1600 - DNA, 401 bp, Homo sapiens
aagctgaatcagaacacttctttgccaagacttgtctgcaaattcttaacctttttttgtttgccaagaacaaagaaaaattgttgtaaacttagctgctgctgtaacatatgagcagtcttttccgaaaatgcaaattagacaaacaagaatcattacatcatttgcagaaatgcagttacatttggtttctgctattgygtgtgtatatatatatatgtatatatattactttcatatcttacttgataccttttgtagtgctttaccattttcaaagcacttgcatatgtgtcgtattatttgatcttttctgagatccaaagtttttaacatgcttcatgcttgaaaactttgatacttcaatttatatgatgcatgtaacatacaacaaatgtttt

SEQ ID NO: 1601 - DNA, 401 bp, Homo sapiens
ttaaattgcggccatcagaaaataccgtgagaaggtagtgtgtaggtaatggttcagttagcattgaccccagaaaatggaaaaccaagagcaagtcacttttaaagtgaagcaatagattttgaatatggattgttccaactcaccacttcccgaccacaacacaagagtatttcactgtaaattaagagtctaagttarccacagctgtggtataactctgagaatgttttctctacatgtagacaattctggatccttccgtggtgcccgttaccctggtctttaacttttgtcctttgcaggggaggggtcaatgccttcttatttccttgctctttagaattctccaccagagggaggacaagggaaggagtaggtttcacgcgcagttctgagta

SEQ ID NO: 1602 - DNA, 401 bp, Homo sapiens
gtaggtaatggttcagttagcattgaccccagaaaatggaaaaccaagagcaagtcacttttaaagtgaagcaatagattttgaatatggattgttccaactcaccacttcccgaccacaacacaagagtatttcactgtaaattaagagtctaagttaaccacagctgtggtataactctgagaatgttttctctacatrtagacaattctggatccttccgtggtgcccgttaccctggtctttaacttttgtcctttgcaggggaggggtcaatgccttcttatttccttgctctttagaattctccaccagagggaggacaagggaaggagtaggtttcacgcgcagttctgagtaaagtttgaatctgagaaaccccacattcacgaattaaggat

SEQ ID NO: 1603 - DNA, 401 bp, Homo sapiens
acacaagagtatttcactgtaaattaagagtctaagttaaccacagctgtggtataactctgagaatgttttctctacatgtagacaattctggatccttccgtggtgcccgttaccctggtctttaacttttgtcctttgcaggggaggggtcaatgccttcttatttccttgctctttagaattctccaccagagggargacaagggaaggagtaggtttcacgcgcagttctgagtaaagtttgaatctgagaaaccccacattcacgaattaaggatctccagttctgtgtctttattctacccctccctgcctgcttttccactcggcagaactgagtgactttcagcggctgcagtaattttaattattctgagtcgtgctccgaactatgtttt

SEQ ID NO: 1604 - DNA, 401 bp, Homo sapiens
tgcccgttaccctggtctttaacttttgtcctttgcaggggaggggtcaatgccttcttatttccttgctctttagaattctccaccagagggaggacaagggaaggagtaggtttcacgcgcagttctgagtaaagtttgaatctgagaaaccccacattcacgaattaaggatctccagttctgtgtctttattctacycctccctgcctgcttttccactcggcagaactgagtgactttcagcggctgcagtaattttaattattctgagtcgtgctccgaactatgttttttatcagttcctctgaaaattaagttgtagtaagagacgtagtttaagggcacccccttagaagaggccaggttattttttaaggaaaagctgaagatttctaaca

SEQ ID NO: 1605 - DNA, 401 bp, Homo sapiens
acacggcgcagacccagcaggagagcgcaacctagcatctttaaggttcgcttagcccttcctgtgcacctggaaggaagccttatcttaaactcccttccacctagagtttattttcgcctgcgtgcgacagggcttttgtacttaagtgagttaaggaatgaaccccgaactcttctgggaaagccaccaacgttcccmccgcacccctcccagggttcctgaccacggagactctgcttggggcacaggtgtgggagtcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggc

SEQ ID NO: 1606 - DNA, 401 bp, Homo sapiens
cgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcycagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagc

SEQ ID NO: 1607 - DNA, 401 bp, Homo sapiens
aaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacraaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggt

SEQ ID NO: 1608 - DNA, 401 bp, Homo sapiens
acttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattccyattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggct

SEQ ID NO: 1609 - DNA, 401 bp, Homo sapiens
ggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcakagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggct

SEQ ID NO: 1610 - DNA, 401 bp, Homo sapiens
agcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcrtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagat

SEQ ID NO: 1611 - DNA, 401 bp, Homo sapiens
acagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataamtttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggat

SEQ ID NO: 1612 - DNA, 401 bp, Homo sapiens
aaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttktaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtatta

SEQ ID NO: 1613 - DNA, 401 bp, Homo sapiens
ctgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcratcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatat

SEQ ID NO: 1614 - DNA, 401 bp, Homo sapiens
ggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctastactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcacta

SEQ ID NO: 1615 - DNA, 401 bp, Homo sapiens
taatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctmatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccct

SEQ ID NO: 1616 - DNA, 401 bp, Homo sapiens
tgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccargcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagag

SEQ ID NO: 1617 - DNA, 401 bp, Homo sapiens
aggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgwaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaa

SEQ ID NO: 1618 - DNA, 401 bp, Homo sapiens
tcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctrttgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagca

SEQ ID NO: 1619 - DNA, 401 bp, Homo sapiens
tggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctastgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatg

SEQ ID NO: 1620 - DNA, 400 bp, Homo sapiens
tttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgtttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaat

SEQ ID NO: 1621 - DNA, 401 bp, Homo sapiens
gtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcrgggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcct

SEQ ID NO: 1622 - DNA, 400 bp, Homo sapiens
  misc_feature (1)...(400): n = A,T,C or G
catggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactnttgcctccggagccctctgatcctgttt

SEQ ID NO: 1623 - DNA, 401 bp, Homo sapiens
gcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactattgcctccggagccctctgatcctgtttgcagtgatgctcckagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagc

SEQ ID NO: 1624 - DNA, 1160 bp, Homo sapiens
gcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggmagcagaagacatgccagagccccagactgaagatrggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccrgcctcaagtgggtatttgtggacaagatctttgaatatgactctcctactcaccttgaccctggggggttaggccaggaccctattatttctctggacscaactgctgcctcagctstgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaacttt

SEQ ID NO: 1625 - DNA, 400 bp, Homo sapiens
  misc_feature (1)...(400): n = A,T,C or G
aggcagggcggggaagggagtgaccgcccctcctggctgcactnttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgg

SEQ ID NO: 1626 - DNA, 401 bp, Homo sapiens
atcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggmagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtgg

SEQ ID NO: 1627 - DNA, 401 bp, Homo sapiens
ttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatrggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcacctt

SEQ ID NO: 1628 - DNA, 401 bp, Homo sapiens
catctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccrgcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgac

SEQ ID NO: 1629 - DNA, 401 bp, Homo sapiens
cgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacscaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttca

SEQ ID NO: 1630 - DNA, 400 bp, Homo sapiens
tcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtct

SEQ ID NO: 1631 - DNA, 401 bp, Homo sapiens
  misc_feature (1)...(401): n = A,T,C or G
aagtctacaaacctctaagtgctcccagcgtattagctaagtcctgagctccatggagttggatgccctaattctgctttagaaagtcctngttccattaaccgtctcctgagaattctcctggcttccctttttgtttcttgagcagagttcagtcaaggagaggtcaagagagatgatacattacttccagtcactgtrttggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctat

SEQ ID NO: 1632 - DNA, 400 bp, Homo sapiens
tcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaaga

SEQ ID NO: 1633 - DNA, 400 bp, Homo sapiens
  misc_feature (1)...(400): n = A,T,C or G
taaaaaaaatctgtaattttgtagtgactagcagtttaatattcaaacatttaaaatgtgcatattttattaagcnaatggcgtagagttatttggtttaattttctgtaagtaactcgtaaagaattgtcctaaaagctgtgggtgaggactaattcattcaagggaaacaggatctaatgattgcnttgtgaggtatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaa

SEQ ID NO: 1634 - DNA, 401 bp, Homo sapiens
  misc_feature (1)...(401): n = A,T,C or G
atgctgcctcttattccacatttcaacttcactctagttaaatttcagttaaccaatcatttgaagactgaagcaaacaacaacaaaaatctgtaacccacagttttcgtgggacatggttttctaaatgtngtgtcttttcttttctttatattgcttggtaccagatcatttttaggaatctccatattccataggagraaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttg

SEQ ID NO: 1635 - DNA, 59 bp, Homo sapiens
gtgcccaaatgagtttactggtgatcgctgccaaaactaygtaatggccagcttctaca

SEQ ID NO: 1636 - DNA, 401 bp, Homo sapiens
gccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactaygtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctct

SEQ ID NO: 1637 - DNA, 401 bp, Homo sapiens
aactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagrgaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggat

SEQ ID NO: 1638 - DNA, 401 bp, Homo sapiens
acagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttgsagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcc

SEQ ID NO: 1639 - DNA, 401 bp, Homo sapiens
tggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtytactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatacgatgaacattgccaatgggcctcaccatcctaac

SEQ ID NO: 1640 - DNA, 401 bp, Homo sapiens
attgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctamtgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatacgatgaacattgccaatgggcctcaccatcctaaccca

SEQ ID NO: 1641 - DNA, 401 bp, Homo sapiens
gaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgarctactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatacgatgaacattgccaatgggcctcaccatcctaacccaccccccgag

SEQ ID NO: 1642 - DNA, 400 bp, Homo sapiens
aaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaataaatgctccctttcttatgtccaggaaacagcggaaaaagctgcatgaccgtcttcggcagagccttcggtctgaacgaaacaatacgatgaacattgccaatgggcctcaccatcctaacccaccccccgagaatgtccagctggtgaatgtacgttgactctggccagtggaaaaaactgagcctctctcctttgtt

SEQ ID NO: 1643 - DNA, 401 bp, Homo sapiens
acagcggaaaaagctgcatgaccgtcttcggcagagccttcggtctgaacgaaacaatacgatgaacattgccaatgggcctcaccatcctaacccaccccccgagaatgtccagctggtgaatgtacgttgactctggccagtggaaaaaactgagcctctctcctttgttcagacgccttgaagtttattttcgaaagmtcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgc

SEQ ID NO: 1644 - DNA, 401 bp, Homo sapiens
cacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctrcgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctc

SEQ ID NO: 1645 - DNA, 401 bp, Homo sapiens
ccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccrcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctc

SEQ ID NO: 1646 - DNA, 401 bp, Homo sapiens
caaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccraaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcag

SEQ ID NO: 1647 - DNA, 207 bp, Homo sapiens
ctggagcaacggacacactgaaagcatcctttccraaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaag

SEQ ID NO: 1648 - DNA, 844 bp, Homo sapiens
gtatgtgtcagccatgaccaccccggctcgtatgtcacctgtagatttccacacgccaagctcccccaaatcgcccccttcggaaatgtctccaccygtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagcyrgcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacmtgccttccgcctggctgacagcaggactaacccagcagkccgcttctcgacacaggaagaaatccaggccaggctgtctagtgtaattgctaaccaagaccctattgctgtataaaacctaaataaacacagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttc

SEQ ID NO: 1649 - DNA, 401 bp, Homo sapiens
gcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacmtgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttat

SEQ ID NO: 1650 - DNA, 401 bp, Homo sapiens
aaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacktgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttt

SEQ ID NO: 1651 - DNA, 400 bp, Homo sapiens
aaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcc

SEQ ID NO: 1652 - DNA, 401 bp, Homo sapiens
taaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcmttatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctg

SEQ ID NO: 1653 - DNA, 401 bp, Homo sapiens
  misc_feature (1)...(401): n = A,T,C or G
taaatctcttcaaatattaagagtttgactctttgacaactaatacatatatattttaataaccactatgtgccaggaactgtgcttcatatatattattgtgtaattctcanagtaattcccatgacataactatagtacatctgttttaaagatagagaaactgaggctcaaaaagactaagtattttgtaaatattcwaagactggaaataatatttgatttcaagattttcttattccaaaatgtgttctgatctgctgctctaccccatctctactaaaaatacaaaaattagctgggtgcagtggtgcacacctgtaatcccagctacttgggatactgaggtaggagaatcacttgaattcaggaggcagaggttgcagtgagctgagattgca

SEQ ID NO: 1654 - DNA, 401 bp, Homo sapiens
tcaaaaagactaagtattttgtaaatattctaagactggaaataatatttgatttcaagattttcttattccaaaatgtgttctgatctgctgctctaccccatctctactaaaaatacaaaaattagctgggtgcagtggtgcacacctgtaatcccagctacttgggatactgaggtaggagaatcacttgaattcagraggcagaggttgcagtgagctgagattgcaccactgccctccagcctgggtgacagagcaaaaatctgtctcaaaaataaataaatacgtaaatataaaattaaattaactcttgcttgtctcatgacaggtaaagatgatgggacagtggctgcctatcttcagataaaataaaggtaatctccacattaacattacta

SEQ ID NO: 1655 - DNA, 401 bp, Homo sapiens
cccaaacatagaaaagtaactcctagcaggaggcagaagagagcacttaacattatgcggccaagaggttacactggctgctgcctcttatcaatgggtctttcaggtcctttttgggagcaatcctgggcttcattgccctgcctaaactgtagtttccaagcagtttctcaggcagttcctgttacattctgtgatccygcctaatacagtaatttgattccagttgaaaacttccattacatacatgtcttgaatcgggagagttagagccttatactttgttcctctgcaaaactgtaagagcatcactgctgtattaaagggaagtgagtggaaagttgcaaagtgagcctttgagttcaagaaaacagatgaaaatgagcccaagccttggaact

SEQ ID NO: 1656 - DNA, 401 bp, Homo sapiens
ttgccctgcctaaactgtagtttccaagcagtttctcaggcagttcctgttacattctgtgatcctgcctaatacagtaatttgattccagttgaaaacttccattacatacatgtcttgaatcgggagagttagagccttatactttgttcctctgcaaaactgtaagagcatcactgctgtattaaagggaagtgagtrgaaagttgcaaagtgagcctttgagttcaagaaaacagatgaaaatgagcccaagccttggaactacagttctaagttttgagtggtggacagagtgggaaaccacgtagcatgcaaaggggagcggaagggcagaggaaggaagcaaggctacagtgtttggctgtgttctaatgtgctctggcatggagttatcgtga

SEQ ID NO: 1657 - DNA, 401 bp, Homo sapiens
actgtaagagcatcactgctgtattaaagggaagtgagtggaaagttgcaaagtgagcctttgagttcaagaaaacagatgaaaatgagcccaagccttggaactacagttctaagttttgagtggtggacagagtgggaaaccacgtagcatgcaaaggggagcggaagggcagaggaaggaagcaaggctacagtgttkggctgtgttctaatgtgctctggcatggagttatcgtgagtggaactaatattacataacactatgtatattttggaagatggctgggaaatagcctttggagccaatggagatttattaaataaaaattacctcaagcttgatttttcatctttaccaagcaccatagtaaattggcatctctgagactcctgcgggag

SEQ ID NO: 1658 - DNA, 401 bp, Homo sapiens
aaaaaaaaaaagtgaagatattgccacaggtctcaggtcctctttccctgcttcactttctattagttttatcagttaggtttacatttactaagtttagagcatatacaatctttttttctttttttttttttgagacggagtctcgctctgtcgcccaggctggagtgcagcggcaggatctcgactcactgcaagctycgcctaccagattcacgccattctcctgcctcagaccccggagtagccgggactacaggcgcctgtgcaatctctatggtaaccacatttcccagttgactactaccggtaataaaatcaaatggattcagtgctcacaactcttcagtctttgggctactttccattcttgaatttttagctgaattcatctctttggc

SEQ ID NO: 1659 - DNA, 401 bp, Homo sapiens
tattagttttatcagttaggtttacatttactaagtttagagcatatacaatctttttttctttttttttttttgagacggagtctcgctctgtcgcccaggctggagtgcagcggcaggatctcgactcactgcaagctccgcctaccagattcacgccattctcctgcctcagaccccggagtagccgggactacaggygcctgtgcaatctctatggtaaccacatttcccagttgactactaccggtaataaaatcaaatggattcagtgctcacaactcttcagtctttgggctactttccattcttgaatttttagctgaattcatctctttggctggattttgtggtaaagtagttttttgcttattttttcccccaagaagggcttacatggg

SEQ ID NO: 1660 - DNA, 557 bp, Homo sapiens
aatcgggcagccattagaaccaaaacagttctgaggagctcccaggctgcaatgtggtgcgaaatgttttatggacagaaaatggaaatgaggtgcagaaattggaggtgagattcagagatagctgattggttacagctcagcctttgccttgtttgaacatggtttgaacagttgattgactgaagctaggctgctgtgattggctgatactttactatttgttacaaaggcaaattcctaatttaagctttcaaattgtttaartactaagttaggttttactttgttacttaggactcatatcgaggtttctaaagcccacatctgatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaagccacaaattttaaaattctgatataatctaatatctggtattcagctttrtattatcattttaaaatttaatgaacat

SEQ ID NO: 1661 - DNA, 400 bp, Homo sapiens
ctaagttaggttttactttgttacttaggactcatatcgaggtttctaaagcccacatctgatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaagccacaaattttaaaattctgatataatctaatatctggtattcagctttgtattatcattttaaaatttaatgaacatctctggactctaaatatttttctttttaaagttatataaaacattctctttatattcattataactattaaactatttgcctacttatttatattgaaagtccttaatattt

SEQ ID NO: 1662 - DNA, 401 bp, Homo sapiens
gatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaaagccacaaattttaaaattctgatataatctaatatctggtattcagctttrtattatcattttaaaatttaatgaacatctctggactctaaatatttttctttttaaagttatataaaacattctctttatattcattataactattaaactatttgcctacttatttatattgaaagtccttaatatttttacaataatttaataggtttcacaatcatcattacttattatagtttatactgtttgaa

SEQ ID NO: 1663 - DNA, 178 bp, Homo sapiens
gctaagaataaacttgaagacaaagagtagattttgrccagacactgatgctaaagtcaccccgatgctgtctttgcttctaaggtataaattaccttattttwagcaactttttcaccttttcaactctatccctttcctcagcctctttcatatgtgaaataaaatattcacttac

SEQ ID NO: 1664 - DNA, 401 bp, Homo sapiens
ttaacatttgtagtggcagtgaatcctaggggcagccttgcatgttaatgttatgtggttgatttgagaggatggggatctgtgtaatcatatgatgacaatttgggtttgggaatctcagaaatgccatcagtataggaatatggctattctgctcttcctaggctaagaataaacttgaagacaaagagtagattttgrccagacactgatgctaaagtcaccccgatgctgtctttgcttctaaggtataaattaccttattttaagcaactttttcaccttttcaactctatccctttcctcagcctctttcatatgtgaaataaaatattcacttactactgaggatgattttttttaaacctattaaagaatactccatagctacagaggggacc

SEQ ID NO: 1665 - DNA, 401 bp, Homo sapiens
tgctaaagtcaccccgatgctgtctttgcttctaaggtataaattaccttattttaagcaactttttcaccttttcaactctatccctttcctcagcctctttcatatgtgaaataaaatattcacttactactgaggatgattttttttaaacctattaaagaatactccatagctacagaggggaccatatcctttagrgactccgttggggatgatcatatgcagaattattcttgtccctttgcctctgcttaatccccttcacaaagtctgtggctcaaacaaatgagagttggcagtactaaaggaataagttcccagcatacgtctgccatgctttagcatcatttcagattagaagcatggagcaaaggcagggagacgggtcaaacaaaatg

SEQ ID NO: 1666 - DNA, 401 bp, Homo sapiens
ttcctcccttaaacctcaggcaggcactttttcaaaagagaaatcaatcagtcaatcaatcagtcaatcaacagtgagtgaatgaatgactaaattgtttgtttttagcatggcataaaataatccttaatattttgacctcaagcaaccattctgaccatatcttcttccatgcgcctttgactgagtacccagatacaygcagagtcaagttttctagatcacagccttgtcctctaattcagtgccttggtatgaaatctttcttcttctatgtcctttttttgccagatgaaatttcagtctttattcaagatcaagtgcaactgtctctttgaggaaagtcctttgaccgccatttctccccttcagaaggcaaacacctgggggagaagatctgc

SEQ ID NO: 1667 - DNA, 401 bp, Homo sapiens
tgtgttctcatcgaataattcttaaatgaccctatttagtttgattttctaactacattagaaatatatgaaacaattaagaaatcattttttacctgtcatatggcagatggactaacattgatcagggcagtcgaggaggttgtaaggaaatgggtactctcaaacattgctggtgggactatgaagtgttttaatttkttttttttttttagacggaggtttgctcttgttgtccaggctggagtgaaatggcgtgatctcggctcactgcatcctctgcctcagcctcccgagtagctggaattacaggcaccctccaccatgcccagctaatttttgtattttcagtagagacagggtttcaccatgttggccaggctggtcttaaactcctaacc

SEQ ID NO: 1668 - DNA, 401 bp, Homo sapiens
cactacaattgtcattttattttaccttccccttgtaaggtcaaataaaatgttagaatatatagattcatagactatcaactctgagagggaccttaaatatcacatactttattatggaacacttagcacagataaaaaaattcaaacactcactaagagtcacttcatcaaggtaccaaaacataggttaagctactycactatgttttagatgctcacactgtatctttcttcacgacttcataataaagattaagcgttgtgttttggatagtccacgttgtgctgtaagtgtgctactaaattccataccagatactgcctctgagaagcttcagaagaagcaatgaattataaagaatgctaatgcgtagtaaccaggggttacaggtgggaac

SEQ ID NO: 1669 - DNA, 401 bp, Homo sapiens
aaattgtcccttttctgaacagcatttaatcatactgaacaattattcataccttttcttaagcatatgttaatcatattagaaatgccattcccttctcgtgcaaaagggcaaaatcagcaacatccttccaatgtgggtgggtaaatgaaggctctgatacaagaattgaaatgaaatatgtgtgcaaacagttcttaktactgagctgtttaaagaaggcctacctttgcacagaaaatgtctataagaattactcattaatgccacttaatagaggaagagtaggagataacgtgggaacagggtctttttaaaaaataccactttaaagaagaggcttatgcttcatcatagacaaaatgctttgtatagtactaacaggggcatatctattcctt

SEQ ID NO: 1670 - DNA, 401 bp, Homo sapiens
atatagtgacagataactgatacaaatctggaaggtagagaggaagaaagtgttctaggccagagttgtacctcccaaaaagtcgagtcagaaatatgggaggccaggctaaagaaaagtaaagaaattagtaggattggatgtttgaaccactttctttcagtaaatcgctagaagcacccatgcagggttcaagtgaaygtatactggaggccagacctgcccaactatgctgctaaatggtgatcttctcctgaagcgctccatcagggtatgagtaacagggaactccccttgccaagacacacagggagtgtgatgaccctgtccctccaaactgcactttgagagaatggaaccttgttttgtagccaactatattatgccaagaacaaaaagat

SEQ ID NO: 1671 - DNA, 401 bp, Homo sapiens
cagaaatattttcacagatccatttttctctgtgtgacggaggttacataattatatcagtggatgtcctgcagtccagctggtatatgtagagcaactgcatgtttgtatcactctgttaggtgcagtgtaggacacaaataaagagagagaagggagagaacactgccgagtcattaggggcatgctttcagttcctawacagccaagtttttttttaggcttggcctatgcttttttcttagtttgggtttagtatgtattcattcattcatattgccatgtgtgttcaacaaatattttgggatgcctgctctgtgccagacattgtgctaggttagagggatgcaaagacaaattagaactccttttctcaaggagacttctggttattgtatttg

SEQ ID NO: 1672 - DNA, 401 bp, Homo sapiens
gtttggtacttcagtggttgattaactgtttcttaatcctgaaatgtggaggaggtttttgcaagtggttgtagcctggttttgaatgaaggtgaaaatgctctttttgttagctctagatcagcagaggtgaataagcatcatgaatttaggagactggcgtttttttttacataaaagttgctttgttgctaattagtrgattagaattcctttaattgcattctgaccaaagacttttgggtgttcaggagggcaagttagcatgtgttgcatttgaatttatacatttgagacacattttcttactgaagctgatattcatgaagcagaaaagataaaaacttgtacatacctttttatttcttgattttaatgttgaagttctattctcagaatgg

SEQ ID NO: 1673 - DNA, 401 bp, Homo sapiens
actcataatgctgaagacatagtaacaacaatttataataggagagcagttttgtgcagcaaaatagttccgtggagcagaattagatcatgaaaatgttgcatggtgggcatttagtcgtgaaagtataaatctgtacctaatgattgatgtgaatcaggtttcaaacctattagatgtgccatttaaccaggcaacatwtgcccattatttttttgcatgaaaagtaattaccgtatgtttaatagttactgaattgtgactggcaggtgtgccccaccataataataatgatgacaataataatatcttcaacttcaactcactctccacaagtcagggcaaagagagaataaacaatgattatttggcgtgtttgaataatataaaagccagtctag

SEQ ID NO: 1674 - DNA, 401 bp, Homo sapiens
acctctggcatcataaaccatccttccctctgacctctgtgtgaatcagcagactatgatctctgcagaatttaggattaattgcagcaaagaaaaagaacctctctgaaatctaaaatgtagacttggtcattagttcattttgcatgctgtggaaactatatttggcatcattaacagctgcttccatgagatgttgrgcactaaaatatgattggtgaacactcaggattttattttgtggtattggttgcaattatggagatgttgatagatcaatttccacatcatctaaacccttaactaagaaataaagtggtacataatatgcatgtcccctctatatgagactttgttaattttcttaatttaaaaaatttttttaattctatgaaggaaaa

What is claimed is:

1. A method of assessing an agent of interest for neuroleptic activity, comprising: (a) administering an agent of interest to a mouse that is heterozygous knockout for the neuregulin gene, wherein said mouse exhibits a behavioral phenotype comprising abnormal behavior selected from the group consisting of hyperactivity, deficit in social interaction and prepulse inhibition; and (b) assessing the behavioral phenotype of the mouse in response to the agent to determine if there is a decrease in the abnormal behavior, wherein a decrease in the abnormal behavior is associated with neuroleptic activity of the agent.

2. The method of claim 1, wherein the abnormal behavior is hyperactivity shown by open field locomotor activity and wherein assessment of the behavioral phenotype of the mouse comprises an open field test.

* * * * *